United States Patent
Facchini et al.

(10) Patent No.: US 11,479,586 B2
(45) Date of Patent: Oct. 25, 2022

(54) POLYNUCLEOTIDES AND POLYPEPTIDES USEFUL FOR MAKING ALKALOID COMPOUNDS

(71) Applicant: Antheia, Inc., Menlo Park, CA (US)

(72) Inventors: Peter James Facchini, Calgary (CA); Joseph E. Tucker, Strathmore (CA)

(73) Assignee: Antheia, Inc., Menlo Park, CA (US)

( * ) Notice: Subject to any disclaimer, the term of this patent is extended or adjusted under 35 U.S.C. 154(b) by 0 days.

(21) Appl. No.: 16/312,895

(22) PCT Filed: Jun. 27, 2017

(86) PCT No.: PCT/CA2017/050779
§ 371 (c)(1),
(2) Date: Dec. 21, 2018

(87) PCT Pub. No.: WO2018/000089
PCT Pub. Date: Jan. 4, 2018

(65) Prior Publication Data
US 2019/0194269 A1    Jun. 27, 2019

Related U.S. Application Data

(60) Provisional application No. 62/355,022, filed on Jun. 27, 2016, provisional application No. 62/433,431, filed on Dec. 13, 2016, provisional application No. 62/514,104, filed on Jun. 2, 2017.

(51) Int. Cl.
| | | |
|---|---|---|
| *C12N 15/82* | (2006.01) | |
| *C12N 15/81* | (2006.01) | |
| *C07K 14/415* | (2006.01) | |
| *C12P 17/18* | (2006.01) | |
| *C12P 17/12* | (2006.01) | |
| *C12N 9/00* | (2006.01) | |
| *C12N 15/52* | (2006.01) | |
| *C12N 15/80* | (2006.01) | |

(52) U.S. Cl.
CPC .............. *C07K 14/415* (2013.01); *C12N 9/00* (2013.01); *C12N 15/52* (2013.01); *C12N 15/80* (2013.01); *C12N 15/81* (2013.01); *C12N 15/8261* (2013.01); *C12P 17/12* (2013.01); *C12P 17/18* (2013.01)

(58) Field of Classification Search
None
See application file for complete search history.

(56) References Cited

U.S. PATENT DOCUMENTS

| | | |
|---|---|---|
| 6,573,428 B1 | 6/2003 | Vodkin et al. |
| 10,544,420 B2 | 1/2020 | Smolke et al. |
| 2009/0156815 A1 | 6/2009 | Wang et al. |
| 2016/0208269 A1 | 7/2016 | Smolke et al. |
| 2020/0325509 A1 | 10/2020 | Enquist-Newman et al. |
| 2021/0062235 A1 | 3/2021 | Smolke et al. |

FOREIGN PATENT DOCUMENTS

| | | |
|---|---|---|
| WO | 2011058446 A2 | 5/2011 |
| WO | 2015081437 A1 | 6/2015 |
| WO | WO2015/173590 A1 | 9/2015 |
| WO | 2018005553 A1 | 1/2018 |

OTHER PUBLICATIONS

Grothe et al, 2001, The Journal of Biological Chemistry, 276:30717-30723.*
Zulak et al, 2007, Planta, 225:1085-1106.*
Dastmalchi et al, 2019, Plant Physiology, 181:916-933.*
Chen et al, 2018, Nature Chemical Biology, 14:738-743.*
Facchini, P. J., "GenBank Accession No. FE967184". Mar. 31, 2008 (Mar. 31, 2008), [online] [retrieved on May 15, 2019 (May 15, 2019)]. Retrieved from the Internet <https://www.ncbi.nlm.nih.gov/nuccore/FE967184>.
Glenn, W. S. et al., "Recent progress in the metabolic engineering of alkaloids in plant 1-49 systems", Curr. Opin. Biotechnol., Apr. 2013 (Apr. 2013), vol. 24(2), pp. 354-365.
International Report on Patentability dated Jan. 1, 2019, in PCT/CA2017/050779.
Database EMBL [Online] Jul. 2, 2015 (Jul. 2, 2015),"*Papaver somniferum* (opium poppy) reticuline epimerase ID—AKO60181 ; SV 1 ; linear; genomic DNA; STD; PLN; 2703 BP.", retrieved from EBI accession No. EM_CDS:AKO60181.
Database Geneseq [Online] Apr. 9, 2015 (Apr. 9, 2015),"Papaver somniferum OMT protein, SEQ ID 543.", retrieved from EBI accession No. GSP:BBU80692 Database accession No. BBU80692.
Winzer et al., Science, 336:1704-1708 (2012).
Hagel et al., Nature Chemical Biology, 6:273-275 (2010).
Morris et al., "Plug-and-Play Benzylisoquinoline Alkaloid Biosynthetic Gene Discovery in Engineered Yeast" in Methods in Enzymology, (Elsevier 2016).
Galanie et al., Science, 349:1095-1100 (2015).
Supplementary Partial European Search Report issued in EP Application No. 17818778.7.
Shitan et al., Plant Biotechnology, 31: 453-463 (2014).
Fossati et al., PLOS ONE, DOI : 10.1371/journai.pone.0124453 (2015).
Sabarna, Internet Citation, [Online], Retrieved from the Internet: URL:http://sundoc.bibliothek.uni -halle.de/ Jun. 22, 2007 (Jun. 22, 2007).

(Continued)

Primary Examiner — Jason Deveau Rosen
(74) *Attorney, Agent, or Firm* — Kristin D. Smith; Steve D Beyer

(57) ABSTRACT

Polynucleotides and polypeptides useful in the manufacture of a class of chemical compounds known as alkaloids are provided. The polynucleotides and polypeptides may be used to synthesize alkaloids, including reticuline, thebaine and morphine, in vivo and in vitro. The polynucleotides further may be used to examine the presence of the polynucleotides in a cell or a cell extract, and to modulate expression thereof in living cells.

11 Claims, 11 Drawing Sheets
Specification includes a Sequence Listing.

(56) References Cited

OTHER PUBLICATIONS

Fisinger et al., Natural Product Communications, 2: 249-253 (2007).
Beaudoin et al., Planta, 240: 19-32 (2014).
Extended European Search Report issued in EP Application No. 17818778.7.
Choe et al., Forensic Science International, 222:387-393 (2012).
Samanani et al., Plant Journal, 47:547-563 (2006).
Facchini et al., Phytochemi, 64:177-186 (2003).
Kisselev L., Structure, 2002, vol. 10: 8-9.
Witkowski et al., Biochemistry 38:11643-11650, 1999.
Whisstock et al., Quarterly Reviews of Biophysics 2003, vol. 36 (3): 307-340.
Devos et al., Proteins: Structure, Function and Genetics, 2000, vol. 41: 98-107.
U.S. Non-Final Office Action dated Aug. 28, 2020 in U.S. Appl. No. 16/312,776.
U.S. Notice of Allowance dated Mar. 15, 2021 in U.S. Appl. No. 16/312,776.
Farrow et al. "Stereochemical Inversion of (S)-reticuline by a cytochrome P450 fusion in opium poppy" Nature Chemical Biology, vol. 11, Sep. 2015, p. 728-732.
Notice of Allowance dated Jun. 25, 2021 in U.S. Appl. No. 16/312,776.
U.S. Office Action dated Sep. 16, 2021 from U.S. Appl. No. 16/984,900.
U.S. Final Office Action dated Apr. 27, 2022 from U.S. Appl. No. 16/984,900.
Sanggil C et al., "Genetic and chemical components analysis of Papaver setigerum naturalized in Korea", Forensic Science International, (2012), vol. 222, pp. 387-393.

* cited by examiner (S)-norcoclaurine (S)-coclaurine (S)-N-methylcoclaurine (S)-3'-hydroxy-N-methylcoclaurine (S)-reticuline (R)-reticuline Salutaridine Salutaridinol Thebaine Codeinone Codeine Morphine Morphinone Oripavine

POLYNUCLEOTIDES AND POLYPEPTIDES USEFUL FOR MAKING ALKALOID COMPOUNDS

RELATED APPLICATIONS

This application is a United States national stage filing of International Patent Application No. PCT/CA2017/050779, filed Jun. 27, 2017, which in turn claims the priority benefit of U.S. Provisional Patent Application No. 62/355,022, filed on Jun. 27, 2016; U.S. Provisional Patent Application No. 62/433,431, filed on Dec. 13, 2016; and U.S. Provisional Patent Application No. 62/514,104, filed on Jun. 2, 2017, each of which is incorporated by reference herein in its entirety.

The instant application contains a Sequence Listing that has been submitted electronically in ASCII format and is hereby incorporated by reference in its entirety. The ASCII copy was created on May 13, 2019, is named 16312895SeqList.txt and is 1,835,334 bytes in size.

FIELD OF THE DISCLOSURE

The compositions and methods disclosed herein relate to a class of chemical compounds known as alkaloids. More particularly, the present disclosure relates to polynucleotides and polypeptides useful for making alkaloid compounds, including reticuline, and opiate compounds including thebaine and morphine.

BACKGROUND OF THE DISCLOSURE

The following paragraphs are provided by way of background to the present disclosure. They are not however an admission that anything discussed therein is prior art or part of the knowledge of persons skilled in the art.

Plant derived alkaloids have long been recognized to be useful as therapeutic agents, or as precursor compounds for use in the manufacture of therapeutic agents. Morphine, for example, is produced by plants belonging to the Papaveraceae and techniques for the extraction of morphine from opium poppy (*Papaver somniferum*) (Sertürner (1817), Ann. Phys: 56-90), as well as techniques for chemical de novo synthesis (Gates and Tschudi (1956), J. of the American Chemical Society, 78 (7): 1380-1393) have long been known to the art. Moreover techniques to obtain morphine preparations continue to evolve (see, for example, U.S. Pat. Nos. 7,495,098 and 6,054,584).

It is also known that alkaloids, including morphine, in planta are produced by polypeptide modulated chemical conversion reactions from precursor compounds. In order for relatively complex alkaloid compounds to accumulate in plant tissues, it is required that a plethora of different chemical reactions is performed in concert within these plant tissues. Thus, in principle, it is generally understood that plant polypeptides and the genes encoding these polypeptides, play an instrumental role in the in planta synthesis of plant alkaloids. However for many plant alkaloids, it is unknown which genes and polypeptides are pertinent, and whether and how these genes can be implemented to produce certain plant alkaloids ex planta. There exists, therefore, a paucity of biosynthetic production methodologies for plant alkaloid compounds. On the other hand, the aforementioned synthetic manufacturing methods, as well as techniques for extraction of alkaloids from natural sources known to the art suffer from low alkaloid yields or are expensive.

SUMMARY OF THE DISCLOSURE

The following paragraphs are intended to introduce the reader to the more detailed description that follows and not to define or limit the claimed subject matter of the present disclosure.

In one aspect, the present disclosure relates to certain alkaloid compounds.

In another aspect, the present disclosure relates to polynucleotides and polypeptides useful for making alkaloid compounds including, without limitation, reticuline, thebaine, morphine and compounds related thereto.

In accordance with one aspect, the present disclosure provides, in at least one embodiment, a composition comprising an isolated polynucleotide comprising a nucleic acid sequence selected from the group consisting of:

(a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93; SEQ. ID NO: 113 to SEQ. ID NO: 505 or SEQ. ID. NO: 766;

(b) a nucleic acid sequence that is substantially identical to any one of the nucleic acid sequences of (a);

(c) a nucleic acid sequence that is substantially identical to any one of the nucleic acid sequences of (a) but for the degeneration of the genetic code;

(d) a nucleic acid sequence that is complementary to any one of the nucleic acid sequences of (a);

(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and (g) a nucleic acid sequence that hybridizes under stringent conditions to any one of the nucleic acid sequences set forth in (a), (b), (c), (d), (e) or (f).

In some embodiments, the present disclosure provides, a composition comprising at least two polynucleotides encoding at least two polypeptides, wherein the at least two polynucleotides independently have a nucleic acid sequence selected from the group consisting of (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID. NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 or SEQ. ID. NO: 766;

(b) a nucleic acid sequence of which at least one is substantially identical to any one of the nucleic acid sequences of (a);

(c) a nucleic acid sequence of which at least one is substantially identical to any one of the nucleic acid sequences of (a) but for the degeneration of the genetic code;

(d) a nucleic acid sequence of which at least one is complementary to any one of the nucleic acid sequences of (a);

(e) a nucleic acid sequence encoding any two polypeptides having the amino acid sequence set forth in SEQ. ID NO: 24, SEQ. ID NO: 25, SEQ. ID NO: 26, SEQ. ID NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID. NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and (g) at least one of which hybridizes under stringent conditions to any one of the nucleic acid sequences set forth in (a), (b), (c), (d), (e) or (f).

In some embodiments, the at least two polynucleotides can be selected from a first polynucleotide comprising a first nucleic acid sequence comprising either SEQ. ID NO: 6 or SEQ. ID NO: 372 and a second polynucleotide comprising a second nucleic acid sequence comprising SEQ. ID NO: 384, SEQ. ID NO: 902 or SEQ. ID NO: 903.

In some embodiments, the first and second polynucleotide are not linked by another polynucleotide.

In some embodiments, the first and second nucleotide can be linked by another polynucleotide.

In some embodiments, the first and second polynucleotide can be linked by another polynucleotide not naturally linking the first and second polynucleotide.

In accordance with another aspect, the present disclosure provides, in at least one embodiment, an expression vector comprising a polynucleotide comprising at least one nucleic acid sequence selected from the group consisting of:

(a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO:

22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 or SEQ. ID. NO: 766;

(b) a nucleic acid sequence that is substantially identical to any one of the nucleic acid sequences of (a);

(c) a nucleic acid sequence that is substantially identical to any one of the nucleic acid sequences of (a) but for the degeneration of the genetic code;

(d) a nucleic acid sequence that is complementary to any one of the nucleic acid sequences of (a);

(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and (g) a nucleic acid sequence that hybridizes under stringent conditions to any one of the nucleic acid sequences set forth in (a), (b), (c), (d), (e) or (f).

In some embodiments, the expression vector further can comprise a polynucleotide element capable of controlling expression of the polynucleotide in a cell.

In some embodiments, the expression vector can comprise a polynucleotide comprising a first nucleic acid sequence comprising either SEQ. ID NO: 6 or SEQ. ID NO: 372, and a second nucleic acid sequence comprising SEQ. ID NO: 384, SEQ. ID NO: 902 or SEQ. ID NO: 903.

In another aspect, the present disclosure provides in at least one embodiment, a composition comprising an isolated polypeptide having an amino acid sequence set forth in: SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901.

In some embodiments, the polypeptide can be a functional variant of any of the foregoing polypeptides.

In another aspect the present disclosure provides, in at least one embodiment, a host cell comprising a polynucleotide comprising a nucleic acid sequence selected from the group consisting of:

(a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 or SEQ. ID. NO: 766;

(b) a nucleic acid sequence that is substantially identical to any one of the nucleic acid sequences of (a);

(c) a nucleic acid sequence that is substantially identical to any one of the nucleic acid sequences of (a) but for the degeneration of the genetic code;

(d) a nucleic acid sequence that is complementary to any one of the nucleic acid sequences of (a);

(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and (g) a nucleic acid sequence that hybridizes under stringent conditions to any one of the nucleic acid sequences set forth in (a), (b), (c), (d), (e) or (f).

In some embodiments, the host cell can comprise a second polynucleotide comprising a second nucleic acid sequence independently selected from the sequences set forth in (a), (b), (c), (d), (e), (f) or (g).

In some embodiments, the first and second polynucleotide are not linked by another polynucleotide.

In some embodiments, the first and second polypeptide can be linked by another polynucleotide.

In some embodiments, the first and second polynucleotide can be integrated in a first and second expression vector.

In some embodiments, the first and second polynucleotide can be integrated in a single expression vector.

In some embodiments, the first polynucleotide can comprise a first nucleic acid sequence comprising either SEQ. ID NO: 6 or SEQ. ID NO: 372, and the second polynucleotide can comprise a second nucleic acid sequence comprising SEQ. ID NO: 384, SEQ. ID NO: 902 or SEQ. ID NO: 903.

In some embodiments, the host cell can be a cell not naturally containing the first polynucleotide or the second polynucleotide.

In some embodiments, the first polynucleotide can comprise a first nucleic acid sequence comprising either SEQ. ID NO: 6 or SEQ. ID NO: 372, and the second polynucleotide can comprise a second nucleic acid sequence comprising SEQ. ID NO: 384, SEQ. ID NO: 902 or SEQ. ID NO: 903.

In some embodiments, the host cell can be a cell not naturally containing the first polynucleotide or the second polynucleotide.

In some embodiments, the host cell can be a yeast cell.

In some embodiments, the host cell can be yeast cell selected from a *Saccharomyces cerevisiae* cell or a *Yarrowia lipolytica* cell.

In some embodiments, the host cell can be a plant cell.

In some embodiments, the host cell can comprise modulated levels of an alkaloid.

In some embodiments, the host cell can comprise modulated levels of thebaine.

In another aspect, the present disclosure provides in at least one embodiment, a use of a polynucleotide comprising at least one nucleic acid sequence selected from the group consisting of:

(a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 or SEQ. ID. NO: 766;

(b) a nucleic acid sequence that is substantially identical to any one of the nucleic acid sequences of (a);

(c) a nucleic acid sequence that is substantially identical to any one of the nucleic acid sequences of (a) but for the degeneration of the genetic code;

(d) a nucleic acid sequence that is complementary to any one of the nucleic acid sequences of (a);

(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ.

ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, or SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID. NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

and (g) a nucleic acid sequence that hybridizes under stringent conditions to any one of the nucleic acid sequences set forth in (a), (b), (c), (d), (e) or (f); to make an alkaloid compound.

In some embodiments, the polynucleotide can comprise a first nucleic acid sequence comprising either SEQ. ID NO: 6 or SEQ. ID NO: 372, and second nucleic acid sequence comprising SEQ. ID NO: 384, SEQ. ID NO: 902 or SEQ. ID NO: 903.

In some embodiments, the alkaloid compound can be selected from the group consisting of (S)-norcoclaurine, (S)-coclaurine, (S)—N-methylcoclaurine, (S)-3'-hydroxy-N-methylcoclaurine, (S)-reticuline, (R)-reticuline, salutaridine, salutaridinol, thebaine, oripavine, morphinone, codeinone, codeine and morphine.

In some embodiments, the polynucleotide can comprise a first nucleic acid sequence comprising either SEQ. ID NO: 6 or SEQ. ID NO: 372, and second nucleic acid sequence comprising SEQ. ID NO: 384, SEQ. ID NO: 902 or SEQ. ID NO: 903, and the alkaloid compound is thebaine.

In some embodiments, the alkaloid compound can be (R)-reticuline or a (R)-reticuline pathway-precursor, wherein the (R)-reticuline precursor has the chemical formula (I):

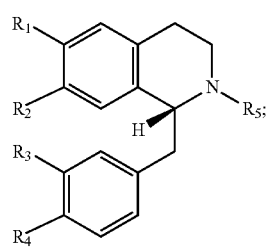

(I)

wherein $R_1$ is an hydroxyl or a methoxy group; $R_2$ is a hydroxyl group; $R_3$ is a hydroxyl group or a hydrogen atom; $R_4$ is a hydroxyl group or a methoxy group and $R_5$ is a methyl group or a hydrogen atom.

In some embodiments, the (R)-reticuline pathway precursor can be selected from (S)-norcoclaurine; (S)-coclaurine; (S)—N-methylcoclaurine; (S)-3'-hydroxy-N-methylcoclaurine; or (S)-reticuline.

In some embodiments, the alkaloid can be an opiate alkaloid.

In some embodiments, the opiate alkaloid can have the chemical formula (II):

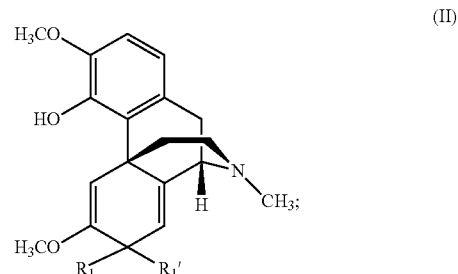

(II)

wherein $R_1$ is an hydroxyl group and $R_1'$ is a hydrogen atom, or wherein $R_1$ and $R_1'$ taken together are an oxo group.

In some embodiments, the opiate alkaloid can have the chemical formula (III):

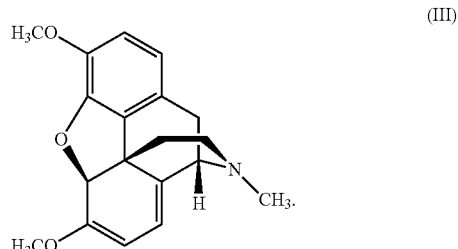

(III)

In some embodiments, the opiate alkaloid can have the chemical formula (IV):

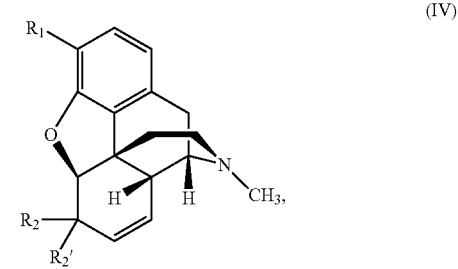

(IV)

wherein $R_1$ is an hydroxyl group or a methoxy group; and $R_2$ is a hydroxyl group and $R_2'$ is a hydrogen atom; or $R_2$ and $R_2'$ taken together are an oxo group.

In some embodiments, the opiate alkaloid can be selected from the group consisting of salutaridine; salutaridinol; thebaine; oripavine; morphinone; codeinone; codeine and morphine.

In some embodiments, the opiate alkaloid can have the chemical formula (II):

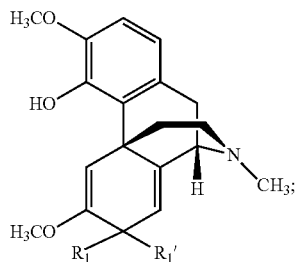

wherein $R_1$ is an hydroxyl group and $R_1'$ is a hydrogen atom, or wherein $R_1$ and $R_1'$ taken together are an oxo group; or an opiate alkaloid having the chemical formula (III):

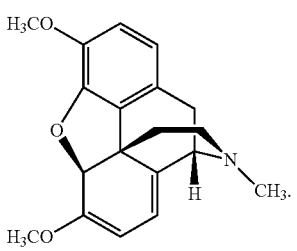

In some embodiments, the opiate alkaloid can have the chemical formula (IV):

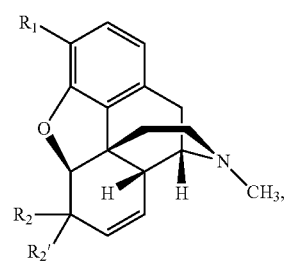

wherein $R_1$ is an hydroxyl group or a methoxy group; and $R_2$ is a hydroxyl group and $R_2'$ is a hydrogen atom; or $R_2$ and $R_2'$ taken together are an oxo group.

In some embodiments, the alkaloid can be thebaine.

In some embodiments, the present disclosure provides a use of a first polypeptide and a second polypeptide encoded by a first and second nucleic acid sequence (i) and (ii) selected from the group consisting of:

(a) (i) either SEQ. ID NO: 6 or SEQ. ID NO: 372, and (ii) SEQ. ID NO: 384, SEQ. ID NO: 902 or SEQ. ID NO: 903;

(b) (i) a nucleic acid sequence substantially identical to either SEQ. ID NO: 6 or SEQ. ID NO: 372, and (ii) a nucleic acid sequence substantially identical to SEQ. ID NO: SEQ. ID NO: 384, SEQ. ID NO: 902 or SEQ. ID NO: 903;

(c) (i) a nucleic acid sequence substantially identical to either SEQ. ID NO: 6 or SEQ. ID NO: 372 but for the degeneration of the genetic code, and (ii) the a nucleic acid sequence substantially identical to SEQ. ID NO: SEQ. ID NO: 384, SEQ. ID NO: 902 or SEQ. ID NO: 903, but for the degeneration of the genetic code;

(d) (i) a nucleic acid sequence complementary to either SEQ. ID NO: 6 or SEQ. ID NO: 372, and (ii) a nucleic acid sequence complementary to SEQ. ID NO: 384, SEQ. ID NO: 902 or SEQ. ID NO: 903;

(e) (i) a nucleic acid sequence encoding a polypeptide comprising SEQ. ID NO: 29 or SEQ. ID NO: 900, and (ii) a nucleic acid sequence encoding a polypeptide comprising SEQ. ID NO: 779 or SEQ. ID NO: 901;

(f) (i) a nucleic acid sequence encoding a polypeptide that is a functional variant of a polypeptide comprising SEQ. ID NO: 29 or SEQ. ID NO: 900, and (ii) a nucleic acid sequence encoding a polypeptide that is a functional variant of a polypeptide comprising SEQ. ID NO: 779 or SEQ. ID NO: 901; and (g) (i) a nucleic acid sequence hybridizing to any of the nucleic acid sequences of (a)(i), (b)(i), (c)(i), (d)(i), (e)(i) or (f)(i), and (ii) a nucleic acid sequence hybridizing to any of the nucleic acid sequences of (a)(ii), (b)(ii), (c)(ii), (d)(ii), (e)(ii) or (f)(ii).

to make thebaine.

In some embodiments, the alkaloid can be made under in vitro conditions.

In some embodiments, the alkaloid can be made under in vivo conditions.

In another aspect, the present disclosure provides, in at least one embodiment, a polynucleotide comprising at least one nucleic acid sequence selected from the group consisting of:

(a) SEQ. ID NO: 384; SEQ. ID NO: 902 or SEQ. ID NO: 903;

(b) a nucleic acid sequence of which at least one is substantially identical to any one of the nucleic acid sequences of (a);

(c) a nucleic acid sequence of which at least one is substantially identical to any one of the nucleic acid sequences of (a) but for the degeneration of the genetic code;

(d) a nucleic acid sequence of which at least one is complementary to any one of the nucleic acid sequences of (a);

(e) a nucleic acid sequence encoding a polypeptide having the amino acid sequence set forth in SEQ. ID NO: 779 or SEQ. ID NO: 901;

(f) a nucleic acid sequence encoding a functional variant of a polypeptide having the amino acid sequence set forth in SEQ. ID NO: 770 or SEQ. ID NO: 901; and (g) a nucleic acid sequence that hybridizes under stringent conditions to any one of the nucleic acid sequences set forth in (a), (b), (c), (d), (e) or (f);

expressed in a heterologous host cell to facilitate transport of an alkaloid compound across a cellular membrane.

In some embodiments, the alkaloid compound is selected from (S)-norcoclaurine, (S)-coclaurine, (S)—N-methylcoclaurine, (S)-3'-hydroxy-N-methylcoclaurine, (S)-reticuline, (R)-reticuline, salutaridine, salutaridinol, thebaine, oripavine, morphinone, codeinone, codeine and morphine.

In some embodiments, the heterologous host cell is a microbial host cell.

In some embodiments, the heterologous host cell is a *Saccharomyces cerevisiae* host cell or a *Yarrowia lipolytica* host cell.

In another aspect, the present disclosure provides, in at least one embodiment, a method for preparing an alkaloid, the method comprising
(A) providing a chimeric polynucleotide comprising as operably linked components:
  (i) a first polynucleotide comprising a nucleic acid sequence selected from the group consisting of:
    (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID. NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 or SEQ. ID. NO: 766;
    (b) a nucleic acid sequence that is substantially identical to any one of the nucleic acid sequences of (a);
    (c) a nucleic acid sequence that is substantially identical to any one of the nucleic acid sequences of (a) but for the degeneration of the genetic code;
    (d) a nucleic acid sequence that is complementary to any one of the nucleic acid sequences of (a);
    (e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;
    (f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID. NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and
    (g) a nucleic acid sequence that hybridizes under stringent conditions to any one of the nucleic acid sequences set forth in (a), (b), (c), (d), (e) or (f); and
  (ii) a second polynucleotide capable of controlling expression in a host cell;
(B) introducing the chimeric polynucleotide into a host cell that endogenously produces or is exogenously supplied with a first alkaloid;
(C) growing the host cell to produce a polypeptide expressed by the first polynucleotide and to further produce a second alkaloid by converting the first alkaloid into the second alkaloid in a reaction mediated by the polypeptide; and
(D) recovering the second alkaloid from the cell.

In another aspect, the present disclosure provides, in at least one embodiment, a method for modulating expression of polynucleotide in a cell naturally expressing such polynucleotide, the method comprising:
(1) providing a cell naturally expressing a polynucleotide;
(2) mutagenizing the cell;
(3) growing the cell to obtain a plurality of cells; and
(4) determining if the plurality of cells comprises a cell comprising modulated levels of a polypeptide encoded by the polynucleotide; and
wherein the polynucleotide comprises a nucleic acid sequence selected from the group consisting of:
  (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82 SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 or SEQ. ID. NO: 766;

(b) a nucleic acid sequence that is substantially identical to any one of the nucleic acid sequences of (a);

(c) a nucleic acid sequence that is substantially identical to any one of the nucleic acid sequences of (a) but for the degeneration of the genetic code;

(d) a nucleic acid sequence that is complementary to any one of the nucleic acid sequences of (a);

(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID. NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and (g) a nucleic acid sequence that hybridizes under stringent conditions to any one of the nucleic acid sequences set forth in (a), (b), (c), (d), (e) or (f).

In some embodiments, the method further can comprise a step (5): selecting a cell comprising modulated levels of the polypeptide and growing such cell to obtain a plurality of cells.

In another aspect, the present disclosure further provides, in at least on embodiment, a method for producing a seed setting plant comprising modulated expression of a polynucleotide in a cell naturally expressing the polynucleotide, the method comprising:

(a) providing a seed setting plant naturally expressing a polynucleotide;

(b) mutagenizing seed of the plant to obtain mutagenized seed;

(c) growing the mutagenized seed into the next generation mutagenized plants capable of setting the next generation seed; and (d) obtaining the next generation seed, or another portion of the mutagenized plants, and analyzing if the next generation plants or next generation seed exhibits modulated polynucleotide expression; and wherein the polynucleotide comprises a nucleic acid sequence selected from the group consisting of:

(a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 or SEQ. ID. NO: 766;

(b) a nucleic acid sequence that is substantially identical to any one of the nucleic acid sequences of (a);

(c) a nucleic acid sequence that is substantially identical to any one of the nucleic acid sequences of (a) but for the degeneration of the genetic code;

(d) a nucleic acid sequence that is complementary to any one of the nucleic acid sequences of (a);

(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and (g) a nucleic acid sequence that hybridizes under stringent conditions to any one of the nucleic acid sequences set forth in (a), (b), (c), (d), (e) or (f).

In another aspect, the present disclosure further provides, in at least one embodiment, a method of reducing the expression of a polynucleotide in a cell, comprising:

(a) providing a cell expressing a polynucleotide; and
(b) silencing expression of the polynucleotide in the cell; and wherein the polynucleotide comprises a nucleic acid sequence selected from the group consisting of:

(a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 or SEQ. ID. NO: 766;

(b) a nucleic acid sequence that is substantially identical to any one of the nucleic acid sequences of (a);
(c) a nucleic acid sequence that is substantially identical to any one of the nucleic acid sequences of (a) but for the degeneration of the genetic code;
(d) a nucleic acid sequence that is complementary to any one of the nucleic acid sequences of (a);
(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and (g) a nucleic acid sequence that hybridizes under stringent conditions to any one of the nucleic acid sequences set forth in (a), (b), (c), (d), (e) or (f).

Other features and advantages of the present disclosure will become apparent from the following detailed description. It should be understood, however, that the detailed description, while indicating preferred implementations of the disclosure, are given by way of illustration only, since various changes and modifications within the spirit and scope of the disclosure will become apparent to those of skill in the art from the detailed description.

BRIEF DESCRIPTION OF THE DRAWINGS

The disclosure is in the hereinafter provided paragraphs described, by way of example, in relation to the attached figures. The figures provided herein are provided for a better understanding of the example embodiments and to show more clearly how the various embodiments may be carried into effect. The figures are not intended to limit the present disclosure.

Figure 1A:
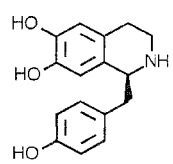
FIG. 1 depicts the chemical structures of (S)-norcoclaurine (FIG. 1A); (S)-coclaurine (FIG. 1B); (S)—N-methylcoclaurine (FIG. 1C); (S)-3'-hydroxy-N-methylcoclaurine (FIG. 1D); (S)-reticuline (FIG. 1E) and (R)-reticuline (FIG. 1F).

The figures together with the following detailed description make apparent to those skilled in the art how the disclosure may be implemented in practice.

DETAILED DESCRIPTION OF THE DISCLOSURE

Various compositions, systems or processes will be described below to provide an example of an embodiment of each claimed subject matter. No embodiment described below limits any claimed subject matter and any claimed subject matter may cover processes, compositions or systems that differ from those described below. The claimed subject matter is not limited to compositions, processes or systems having all of the features of any one composition, system or process described below or to features common to multiple or all of the compositions, systems or processes described below. It is possible that a composition, system or process described below is not an embodiment of any claimed subject matter. Any subject matter disclosed in a composition, system or process described below that is not claimed in this document may be the subject matter of another protective instrument, for example, a continuing patent application, and the applicant(s), inventor(s) or owner(s) do not intend to abandon, disclaim or dedicate to the public any such subject matter by its disclosure in this document.

As used herein and in the claims, the singular forms, such "a", "an" and "the" include the plural reference and vice versa unless the context clearly indicates otherwise. Throughout this specification, unless otherwise indicated, "comprise," "comprises" and "comprising" are used inclusively rather than exclusively, so that a stated integer or group of integers may include one or more other non-stated integers or groups of integers.

The term "or" is inclusive unless modified, for example, by "either".

When ranges are used herein for physical properties, such as molecular weight, or chemical properties, such as chemical formulae, all combinations and sub-combinations of ranges and specific embodiments therein are intended to be included. Other than in the operating examples, or where otherwise indicated, all numbers expressing quantities of ingredients or reaction conditions used herein should be understood as modified in all instances by the term "about." The term "about" when referring to a number or a numerical range means that the number or numerical range referred to is an approximation within experimental variability (or within statistical experimental error), and thus the number or numerical range may vary between 1% and 15% of the stated number or numerical range, as will be readily recognized by context. Furthermore any range of values described herein is intended to specifically include the limiting values of the range, and any intermediate value or sub-range within the given range, and all such intermediate values and sub-ranges are individually and specifically disclosed (e.g. a range of 1 to 5 includes 1, 1.5, 2, 2.75, 3, 3.90, 4, and 5). Similarly, other terms of degree such as "substantially" and "approximately" as used herein mean a reasonable amount of deviation of the modified term such that the end result is not significantly changed. These terms of degree should be construed as including a deviation of the modified term if this deviation would not negate the meaning of the term it modifies.

Unless otherwise defined, scientific and technical terms used in connection with the formulations described herein shall have the meanings that are commonly understood by those of ordinary skill in the art. The terminology used herein is for the purpose of describing particular embodiments only, and is not intended to limit the scope of the present invention, which is defined solely by the claims.

All publications, patents and patent applications are herein incorporated by reference in their entirety to the same extent as if each individual publication, patent or patent application was specifically and individually indicated to be incorporated by reference in its entirety.

Terms and Definitions

The term "polynucleotide", as used herein, refers to a sequence of nucleoside or nucleotide monomers, consisting of naturally occurring bases, sugars and intersugar (backbone) linkages. The term also includes modified or substituted sequences comprising non-naturally occurring monomers or portions thereof. The polynucleotides of the present disclosure may be deoxyribonucleic polynucleotides (DNA) or ribonucleic acid polynucleotides (RNA) and may include naturally occurring bases including adenine, guanine, cytosine, thymidine and uracil. The polynucleotides may also contain modified bases. Examples of such modified bases include aza and deaza adenine, guanine, cytosine, thymidine and uracil, and xanthine and hypoxanthine. A sequence of nucleotide or nucleoside monomers may be referred to as a polynucleotide sequence, nucleic acid sequence, a nucleotide sequence or a nucleoside sequence.

The term "polypeptide", as used herein, in conjunction with a reference SEQ. ID NO, refers to any and all polypeptides comprising a sequence of amino acid residues which is (i) substantially identical to the amino acid sequence constituting the polypeptide having such reference SEQ. ID NO, or (ii) encoded by a nucleic acid sequence capable of hybridizing under at least moderately stringent conditions to any nucleic acid sequence encoding the polypeptide having such reference SEQ. ID NO, but for the use of synonymous codons. A sequence of amino acid residues may be referred to as an amino acid sequence, or polypeptide sequence.

The term "nucleic acid sequence encoding a polypeptide", as used herein, in conjunction with a reference SEQ. ID NO, refers to any and all nucleic acid sequences encoding a polypeptide having such reference SEQ. ID NO. Nucleic acid sequences encoding a polypeptide, in conjunction with a reference SEQ. ID NO, further include any and all nucleic acid sequences which (i) encode polypeptides that are substantially identical to the polypeptide having such reference SEQ. ID NO; or (ii) hybridize to any nucleic acid sequences encoding polypeptides having such reference SEQ. ID NO under at least moderately stringent hybridization conditions or which would hybridize thereto under at least moderately stringent conditions but for the use of synonymous codons.

By the term "substantially identical" it is meant that two amino acid sequences preferably are at least 70% identical, and more preferably are at least 85% identical and most preferably at least 95% identical, for example 96%, 97%, 98% or 99% identical. In order to determine the percentage of identity between two amino acid sequences the amino acid sequences of such two sequences are aligned, using for example the alignment method of Needleman and Wunsch (J. Mol. Biol., 1970, 48: 443), as revised by Smith and Waterman (Adv. Appl. Math., 1981, 2: 482) so that the highest order match is obtained between the two sequences and the number of identical amino acids is determined between the two sequences. Methods to calculate the percentage identity between two amino acid sequences are generally art recognized and include, for example, those described by Carillo and Lipton (SIAM J. Applied Math., 1988, 48:1073) and those described in Computational Molecular Biology, Lesk, e.d. Oxford University Press, New York, 1988, Biocomputing: Informatics and Genomics Projects. Generally, computer programs will be employed for such calculations. Computer programs that may be used in this regard include, but are not limited to, GCG (Devereux et al., Nucleic Acids Res., 1984, 12: 387) BLASTP, BLASTN and FASTA (Altschul et al., J. Molec. Biol., 1990:215:403). A particularly preferred method for determining the percentage identity between two polypeptides involves the Clustal W algorithm (Thompson, J D, Higgines, D G and Gibson T J, 1994, Nucleic Acid Res 22(22): 4673-4680 together with the BLOSUM 62 scoring matrix (Henikoff S & Henikoff, J G, 1992, Proc. Natl. Acad. Sci. USA 89: 10915-10919 using a gap opening penalty of 10 and a gap extension penalty of 0.1, so that the highest order match obtained between two sequences wherein at least 50% of the total length of one of the two sequences is involved in the alignment.

By "at least moderately stringent hybridization conditions" it is meant that conditions are selected which promote selective hybridization between two complementary nucleic acid molecules in solution. Hybridization may occur to all or a portion of a nucleic acid sequence molecule. The hybridizing portion is typically at least 15 (e.g. 20, 25, 30, 40 or 50) nucleotides in length. Those skilled in the art will recognize that the stability of a nucleic acid duplex, or hybrids, is determined by the Tm, which in sodium containing buffers is a function of the sodium ion concentration and temperature (Tm=81.5° C.−16.6 (Log 10 [Na+])+0.41 (% (G+C)−600/l), or similar equation). Accordingly, the parameters in the wash conditions that determine hybrid stability are sodium ion concentration and temperature. In order to identify molecules that are similar, but not identical, to a known nucleic acid molecule a 1% mismatch may be assumed to result in about a 1° C. decrease in Tm, for example if nucleic acid molecules are sought that have a >95% identity, the final wash temperature will be reduced by about 5° C. Based on these considerations those skilled in the art will be able to readily select appropriate hybridization conditions. In preferred embodiments, stringent hybridization conditions are selected. By way of example the following conditions may be employed to achieve stringent hybridization: hybridization at 5× sodium chloride/sodium citrate (SSC)/5×Denhardt's solution/1.0% SDS at Tm (based on the above equation) −5° C., followed by a wash of 0.2×SSC/0.1% SDS at 60° C. Moderately stringent hybridization conditions include a washing step in 3×SSC at 42° C. It is understood however that equivalent stringencies may be achieved using alternative buffers, salts and temperatures. Additional guidance regarding hybridization conditions may be found in: Current Protocols in Molecular Biology, John Wiley & Sons, N.Y., 1989, 6.3.1.-6.3.6 and in: Sambrook et al., Molecular Cloning, a Laboratory Manual, Cold Spring Harbor Laboratory Press, 1989, Vol. 3.

The term "functional variant", as used herein, in reference to polynucleotides or polypeptides refers to polynucleotides or polypeptides capable of performing the same function as a noted reference polynucleotide or polypeptide. Thus, for example, a functional variant of the polypeptide set forth in SEQ. ID NO: 46, refers to a polypeptide capable of performing the same function as the polypeptide set forth in SEQ. ID NO: 46. Functional variants include modified a polypeptide wherein, relative to a noted reference polypeptide, the modification includes a substitution, deletion or addition of one or more amino acids. In some embodiments, substitutions are those that result in a replacement of one amino acid with an amino acid having similar characteristics. Such substitutions include, without limitation (i) glutamic acid and aspartic acid; (i) alanine, serine, and threonine; (iii) isoleucine, leucine and valine, (iv) asparagine and glutamine, and (v) tryptophan, tyrosine and phenylalanine. Functional variants further include polypeptides having retained or exhibiting an enhanced alkaloid biosynthetic bioactivity.

The term "chimeric", as used herein in the context of polynucleotides, refers to at least two linked polynucleotides which are not naturally linked. Chimeric polynucleotides include linked polynucleotides of different natural origins. For example polynucleotide constituting a microbial promoter linked to a polynucleotide encoding a plant polypeptide is considered chimeric. Chimeric polynucleotides also may comprise polynucleotides of the same natural origin, provided they are not naturally linked. For example a polynucleotide constituting a promoter obtained from a particular cell-type may be linked to a polynucleotide encoding a polypeptide obtained from that same cell-type, but not normally linked to the polynucleotide constituting the promoter. Chimeric polynucleotides also include polynucleotides comprising any naturally occurring polynucleotides linked to any non-naturally occurring polynucleotides.

The term "(S)-norcoclaurine", as used herein, refers to a chemical compound having the structure set forth in FIG. 1A.

Figure 1B:
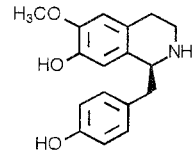

The term "(S)-coclaurine", as used herein, refers to a chemical compound having the structure set forth in FIG. 1B.

Figure 1C:
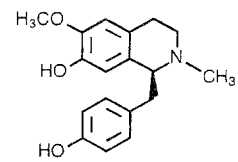

The term "(S)—N-methylcoclaurine", as used herein, refers to a chemical compound having the structure set forth in FIG. 1C.

Figure 1D:
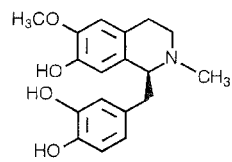

The term "(S)-3'-hydroxy-N-methylcoclaurine", as used herein, refers to a chemical compound having the structure set forth in FIG. 1D.

Figure 1E:
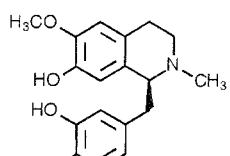

The term "(S)-reticuline", as used herein, refers to a chemical compound having the structure set forth in FIG. 1E.

Figure 1F:
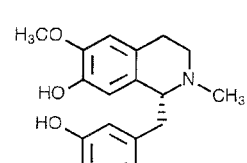

The term "(R)-reticuline", as used herein, refers to a chemical compound having the structure set forth in FIG. 1F.

Figure 2A:
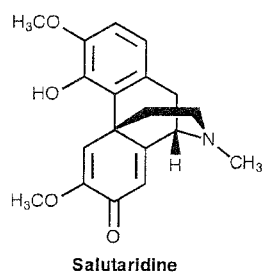
FIG. 2 depicts the chemical structures of certain opiates, notably salutaridine (FIG. 2A), salutaridinol (FIG. 2B), thebaine (FIG. 2C), codeinone (FIG. 2D), codeine (FIG. 2E) and morphine (FIG. 2F).

The term "salutaridine", as used herein, refers to a chemical compound having the structure set forth in FIG. 2A.

Figure 2B:
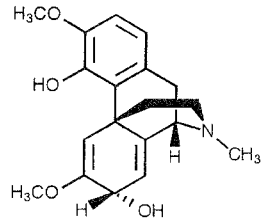

The term "salutaridinol", as used herein, refers to a chemical compound having the structure set forth in FIG. 2B.

Figure 2C:
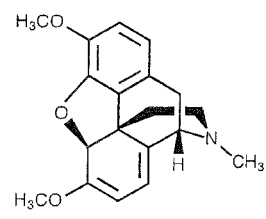

The term "thebaine", as used herein, refers to a chemical compound having the structure set forth in FIG. 2C as well as a compound having the chemical formula (III).

Figure 2D:
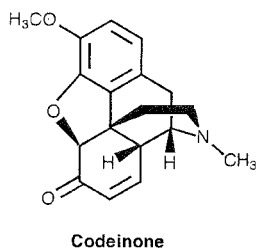

The term "codeinone", as used herein, refers to a chemical compound having the structure set forth in FIG. 2D.

Figure 2E:
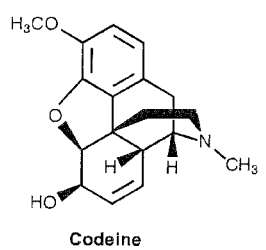

The term "codeine", as used herein, refers to a chemical compound having the structure set forth in FIG. 2E.

Figure 2F:
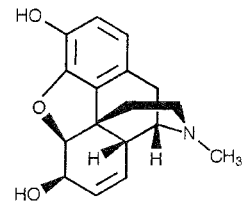

The term "morphine", as used herein, refers to a chemical compound having the structure set forth in FIG. 2F.

Figure 11A:
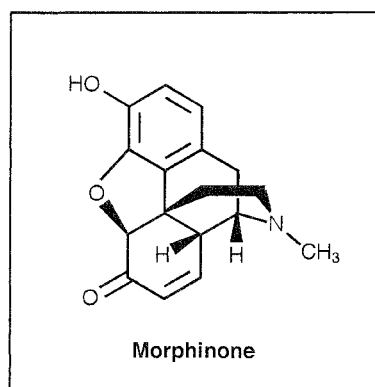
FIG. 11 depicts the chemical structures of certain opiates, notably morphinone (FIG. 11A) and oripavine (FIG. 11B).

The term "morphinone", as used herein, refers to a chemical compound having the structure set forth in FIG. 11A.

Figure 11B:
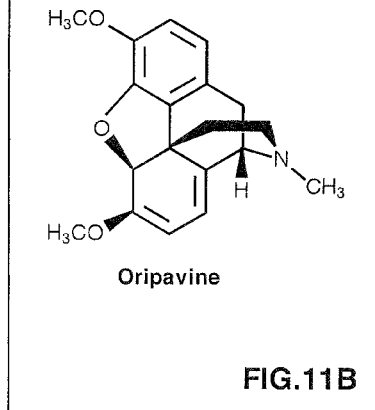

The term "oripavine", as used herein, refers to a chemical compound having the structure set forth in FIG. 11B.

Figure 3:
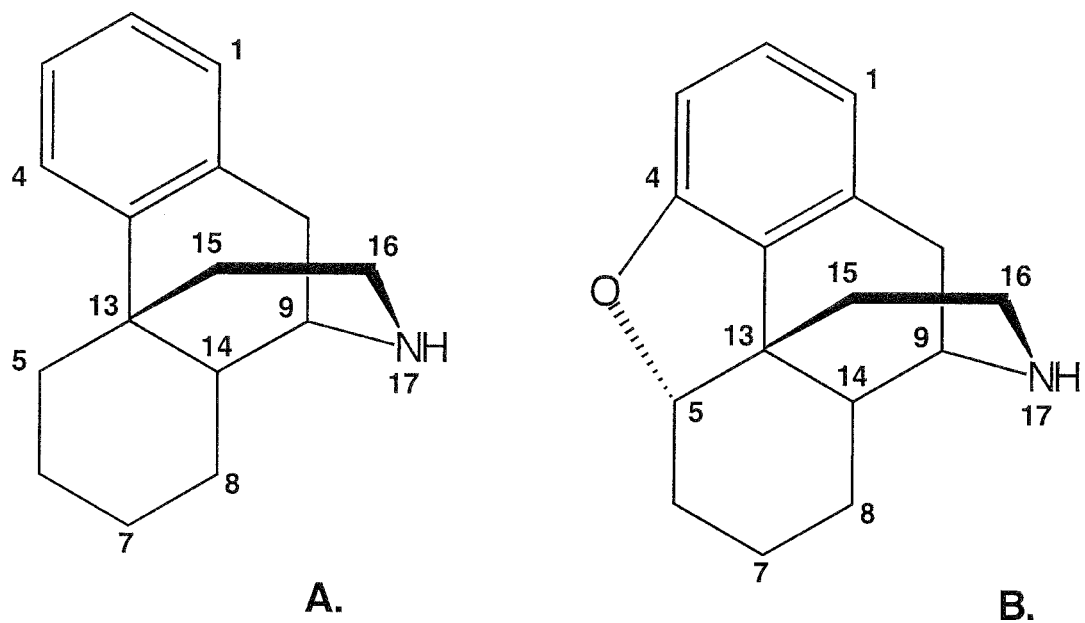
FIG. 3 depicts two prototype structures of an opiate, namely morphinan (FIG. 3A) and furanyl morphinan (FIG. 3B). Certain specific carbon and nitrogen atoms may be referred herein by reference to their position within the morphinan structure e.g. $C_1$, $C_2$, $N_{17}$ etc. The pertinent atom numbering is shown.
Figure 4:
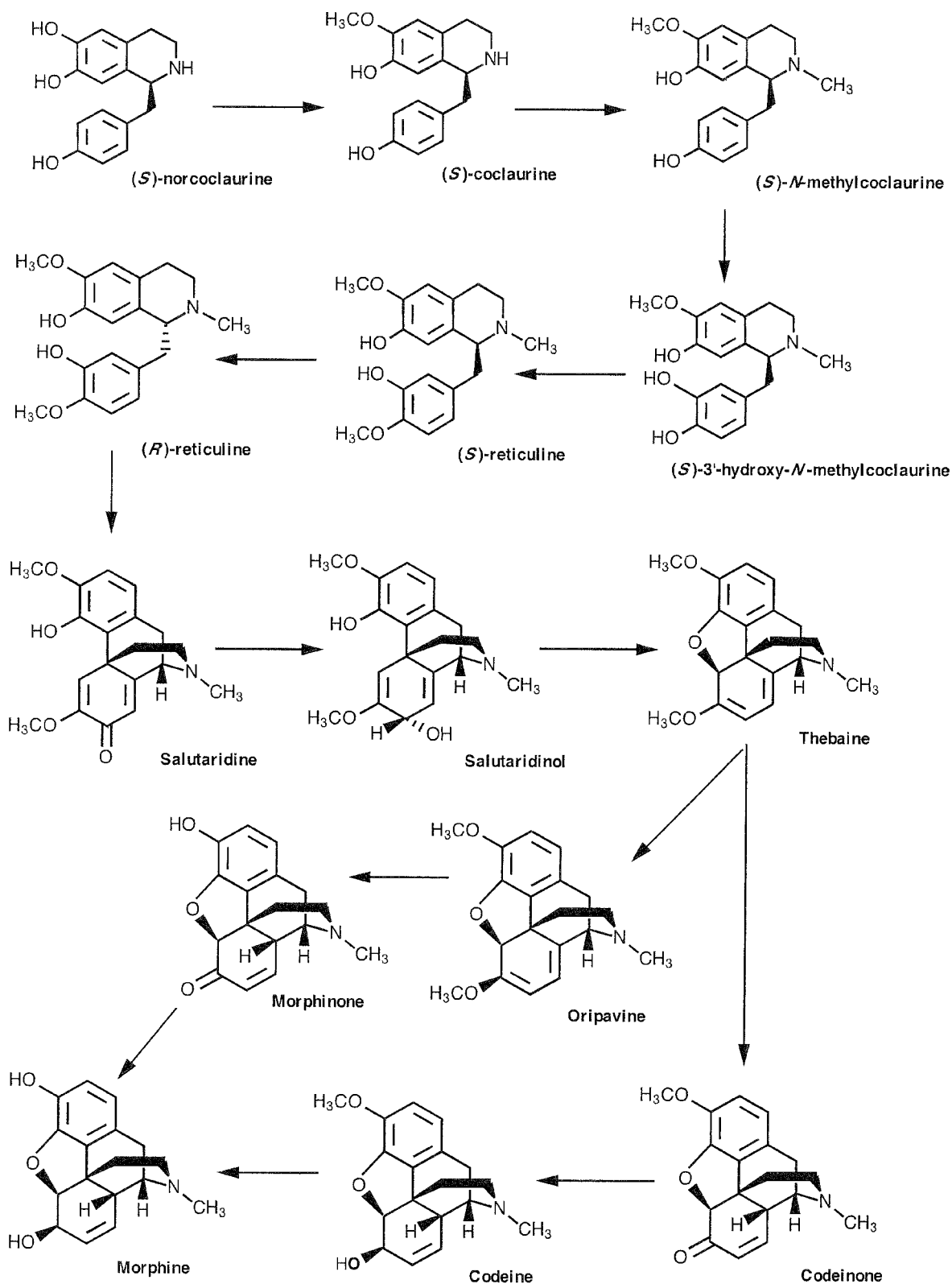
FIG. 4 depicts an alkaloid biosynthesis pathway for the synthesis of reticuline, thebaine and morphine and related alkaloid compounds.

The term "opiate" refers a chemical compound having the prototype chemical structure shown in FIG. 3A. (morphinan) or prototype chemical structure FIG. 3B (furanyl morphinan). Examples of opiates include, without limitation, salutaridine, salutaridinol, thebaine, oripavine, morphinone, codeinone and codeine.

The term "oxo group", as used herein, means a group represented by "=O".

The term (R)-reticuline pathway precursor, as used herein, refers to any one of (S)-norcoclaurine, (S)-coclaurine, (S)—N-methylcoclaurine, (S)-3'-hydroxy-N-methylcoclaurine or (S)-reticuline, and any derivatives thereof.

The term "in vivo" as used herein to describe methods of making alkaloids refers to contacting a first alkaloid with a polypeptide capable of mediating conversion of a first alkaloid within a cell, including, for example, a microbial cell or a plant cell, to form a second alkaloid.

The term "in vitro" as used herein to describe methods of making alkaloids refers to contacting a first alkaloid with a polypeptide capable of mediating a conversion of the first alkaloid in an environment outside a cell, including, without limitation, for example, in a microwell plate, a tube, a flask, a beaker, a tank, a reactor and the like, to form a second alkaloid.

The terms "substantially pure" and "isolated", as may be used interchangeably herein describe a compound, e.g., an alkaloid, polynucleotide or a polypeptide, which has been separated from components that naturally accompany it. Typically, a compound is substantially pure when at least 60%, more preferably at least 75%, more preferably at least 90%, 95%, 96%, 97%, or 98%, and most preferably at least 99% of the total material (by volume, by wet or dry weight, or by mole percent or mole fraction) in a sample is the compound of interest. Purity can be measured by any appropriate method, e.g., in the case of polypeptides, by chromatography, gel electrophoresis or HPLC analysis.

The term "recovered" as used herein in association with an alkaloid refers to a substantially pure form of the alkaloid.

General Implementation

As hereinbefore mentioned, the present disclosure relates to alkaloids. The current disclosure further relates to certain polynucleotides and polypeptides. The herein provide provided polynucleotides are yet further useful in that they facilitate a novel and efficient means of making certain alkaloids, including, in preferred embodiments, reticuline and opiate compounds including, without limitation, thebaine and morphine. Such use of the polynucleotides avoids chemical synthesis of the subject alkaloids and may be conducted at commercial scale. The current disclosure further provides methodologies for the manufacture of certain alkaloids, using cells and organisms not normally capable of synthesizing such alkaloids. Such cells and organisms may be used as a source whence these alkaloids may economically be extracted. The alkaloids produced in accordance with the present disclosure are useful inter alia in the manufacture of pharmaceutical compositions. The herein provided polynucleotides furthermore are useful in that may be employed to examine the presence of such polynucleotides in cells, for example, plant cells. The herein provided polynucleotides are further useful in that that they may be employed to modulate expression of such polynucleotides in cells.

Accordingly, the present disclosure provides, in at least one aspect, and in at least one embodiment, a composition comprising isolated polynucleotide comprising a nucleic acid sequence selected from the nucleic acid sequences consisting of (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 and SEQ. ID. NO: 766;

(b) a nucleic acid sequence that is substantially identical to any one of the nucleic acid sequences of (a);
(c) a nucleic acid sequence that is substantially identical to any one of the nucleic acid sequences of (a) but for the degeneration of the genetic code;
(d) a nucleic acid sequence that is complementary to any one of the nucleic acid sequences of (a);
(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, or SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;
(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and
(g) a nucleic acid sequence that hybridizes under stringent conditions to any one of the nucleic acid sequences set forth in (a), (b), (c), (d), (e) or (f).

In some embodiments, a composition is provided comprising a first and second polynucleotide. In some embodiments, the first and second polynucleotides are naturally linked. In some embodiments, the first and second polynucleotides are not naturally linked. With the term "naturally linked", it is meant that the polynucleotide comprises a first and second polynucleotide linked to one another via a linkage polynucleotide that is identical to the linking polynucleotide in a cell in which the first and second polynucleotide naturally occur. Conversely, the term "not naturally linked" refers to a polynucleotide comprising a first and second polynucleotide, which are linked via a linkage polynucleotide that is not identical to the linkage polynucleotide in a cell in which the first and second polynucleotide naturally occur. This may mean that such first and second polynucleotide are not linked at all via a polynucleotide in a cell in which the constituent polynucleotides naturally occur, and thus the resultant polynucleotide is a chimeric polynucleotide, or, if the first and second polynucleotide are naturally linked in a native cell, the linkage polynucleotide in a native cell differs from the polynucleotide linking the first and second polynucleotide. Thus, by way example, the native linkage polynucleotide between a first and second polynucleotide can include one or more polynucleotides encoding polypeptides or regulatory elements, for example a native promoter element, whereas such polynucleotides may be entirely or in part absent in the polynucleotides provided by the present disclosure. In embodiments, wherein the first and second polynucleotides are not naturally linked, the linkage polynucleotide may comprise a non-native regulatory element. Thus, by way of example only, a first and second polynucleotide may be linked via a linkage polynucleotide comprising a promoter element for expression in a yeast cell. In some embodiments, the compositions of the present disclosure comprise additional polynucleotides, e.g. a $3^{rd}$, $4^{th}$, $5^{th}$, $6^{th}$, $7^{th}$, $8^{th}$, $9^{th}$ $10^{th}$ etc. nucleic acid sequence, wherein such polynucleotides may be naturally linked or non-naturally linked. Accordingly, the present disclosure provides in some embodiments, at least a composition comprising two polynucleotides encoding at least two polypeptides, wherein the at least polynucleotides have a nucleic acid sequence selected from the group consisting of (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 and SEQ. ID. NO: 766;
(b) nucleic acid sequences of which at least one is substantially identical to any one of the nucleic acid sequences of (a);
(c) nucleic acid sequences of which at least one is substantially identical to any one of the nucleic acid sequences of (a) but for the degeneration of the genetic code;
(d) nucleic acid sequences of which at least one is complementary to any one of the nucleic acid sequences of (a);
(e) a nucleic acid sequence encoding any two polypeptides having the amino acid sequence set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ.

ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46,

SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and (g) at least one of which hybridizes under stringent conditions to any one of the nucleic acid sequences set forth in (a), (b), (c), (d), (e) or (f).

In some embodiments, the at least two polynucleotides comprises two nucleic acid sequences (i) and (ii) selected from the group consisting of (a) (i) either SEQ. ID NO: 6 or SEQ. ID NO: 372, and (ii) SEQ. ID NO: 384, SEQ. ID NO: 902 or SEQ. ID NO: 903;

(b) (i) a nucleic acid sequence substantially identical to either SEQ. ID NO: 6 or SEQ. ID NO: 372, and (ii) a nucleic acid sequence substantially identical to SEQ. ID NO: 384, SEQ. ID NO: 902 or SEQ. ID NO: 903;

(c) (i) a nucleic acid sequence substantially identical to either SEQ. ID NO: 6 or SEQ. ID NO: 372, but for the degeneration of the genetic code, and (ii) a nucleic acid sequence substantially identical to SEQ. ID NO: SEQ. ID NO: 384, SEQ. ID NO: 902 or SEQ. ID NO: 903, but for the degeneration of the genetic code;

(d) (i) a nucleic acid sequence complementary to either SEQ. ID NO: 6 or SEQ. ID NO: 372, and (ii) a nucleic acid sequence complementary to SEQ. ID NO: SEQ. ID NO: 384, SEQ. ID NO: 902 or SEQ. ID NO: 903;

(e) (i) a nucleic acid sequence encoding a polypeptide comprising either SEQ. ID NO: 29 or SEQ. ID NO: 900, and (ii) a nucleic acid sequence encoding a polypeptide comprising SEQ. ID NO: 779 or SEQ. ID NO: 901;

(f) (i) a nucleic acid sequence encoding a polypeptide that is a functional variant of a polypeptide comprising either SEQ. ID NO: 29, or SEQ. ID NO: 900, and (ii) a nucleic acid sequence encoding a polypeptide that is a functional variant of a polypeptide comprising SEQ. ID NO: 779 or SEQ. ID NO: 901; and (g) (i) a nucleic acid sequence hybridizing to any of the nucleic acid sequences of (a)(i), (b)(i), (c)(i), (d)(i), (e)(i) or (f)(i), and a nucleic acid sequence hybridizing to any of the nucleic acid sequences of (a)(ii), (b)(ii), (c)(ii), (d)(ii), (e)(ii) or (f)(ii).

In accordance herewith, the polynucleotides of the present disclosure can be linked to other polynucleotides, including, in some embodiments, a polynucleotide capable of controlling expression of the polynucleotide in a host cell. Accordingly, the present disclosure further provides, in some embodiments, a polynucleotide capable of controlling expression in a host cell, linked to a polynucleotide comprising a nucleic acid sequence selected from the nucleic acid sequences consisting of (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 and SEQ. ID. NO: 766;

(b) a nucleic acid sequence that is substantially identical to any one of the nucleic acid sequences of (a);

(c) a nucleic acid sequence that is substantially identical to any one of the nucleic acid sequences of (a) but for the degeneration of the genetic code;

(d) a nucleic acid sequence that is complementary to any one of the nucleic acid sequences of (a);

(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, or SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID. NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ.

ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and (g) a nucleic acid sequence that hybridizes under stringent conditions to any one of the nucleic acid sequences set forth in (a), (b), (c), (d), (e) or (f).

In some embodiments, the polynucleotide capable of controlling expression in a host cell is linked to a polynucleotide comprising two nucleic acid sequences (i) and (ii) selected from the group consisting of (a) (i) either SEQ. ID NO: 6 or SEQ. ID NO: 372, and (ii) SEQ. ID NO: 384, SEQ. ID NO: 902 or SEQ. ID NO: 903;

(b) (i) a nucleic acid sequence substantially identical to either SEQ. ID NO: 6 or SEQ. ID NO: 372, and (ii) a nucleic acid sequence substantially identical to SEQ. ID NO: 384, SEQ. ID NO: 902 or SEQ. ID NO: 903;

(c) (i) a nucleic acid sequence substantially identical to either SEQ. ID NO: 6 or SEQ. ID NO: 372, but for the degeneration of the genetic code, and (ii) a nucleic acid sequence substantially identical to SEQ. ID NO: 384, SEQ. ID NO: 902 or SEQ. ID NO: 903, but for the degeneration of the genetic code;

(d) (i) a nucleic acid sequence complementary to either SEQ. ID NO: 6 or SEQ. ID NO: 372, and (ii) a nucleic acid sequence complementary to SEQ. ID NO: 384;

(e) (i) a nucleic acid sequence encoding a polypeptide comprising either SEQ. ID NO: 29 or SEQ. ID NO: 900, and (ii) a nucleic acid sequence encoding a polypeptide comprising SEQ. ID NO: 779 or SEQ. ID NO: 901;

(f) (i) a nucleic acid sequence encoding a polypeptide that is a functional variant of a polypeptide comprising either SEQ. ID NO: 29, or SEQ. ID NO: 900, and (ii) a nucleic acid sequence encoding a polypeptide that is a functional variant of a polypeptide comprising SEQ. ID NO: 779 or SEQ. ID NO: 901; and (g) (i) a nucleic acid sequence hybridizing to any of the nucleic acid sequences of (a)(i), (b)(i), (c)(i), (d)(i), (e)(i) or (f)(i), and a nucleic acid sequence hybridizing to any of the nucleic acid sequences of (a)(ii), (b)(ii), (c)(ii), (d)(ii), (e)(ii) or (f)(ii).

Polynucleotides capable of controlling expression in a host cell that can be used herein include any transcriptional promoter capable of controlling expression of polypeptides in a host cell. Generally, polynucleotides capable of controlling expression in a host cell are selected to match the type of host cell in which the polynucleotide is introduced, as hereinafter described. Thus, for example, promoters obtained from bacterial cells can be used when a bacterial host is selected in accordance herewith, while a fungal promoter can be used when a fungal host is selected, a plant promoter can be used when a plant cell is selected, and so on. Furthermore, where it is desirable that enhanced expression is achieved in specific tissues, tissue specific promoters can be used, for example seed specific promoters, root specific promoters, floral specific promoters and fruit specific promoters (see, for example, Dutt et al, Horticultural Research, 2014, 1, 1:47). Other promoters that can be used include promoters controllable by an exogenous agent, for example, promoters inducible by an exogenous chemical agent, including, for example the tobacco PR-la promoter which can be induced by salicylic acid (Ohshima et al., 1990, Plant Cell 2, 95-102), or promoters repressible by an exogenous chemical agent, for example a tetracycline repressible promoter (Pecota et al., 2005, Biotechnol Bioeng. 92(2) 117-123). Further polynucleotides capable elements of controlling expression in a host cell include transcriptional terminators, enhancers and the like, all of which can be included in the polynucleotide molecules of the present disclosure. It will be understood by those of ordinary skill in the art that operable linkage of the polynucleotide can include linkage of promoters and sequences capable of controlling expression to coding sequences in the 5' to 3' direction of transcription. The polynucleotides of the present disclosure when linked to polynucleotides capable of controlling expression in a host cell can become chimeric polynucleotides.

In accordance with the present disclosure, the polynucleotide molecules of the present disclosure comprising a polynucleotide capable of controlling expression in a host cell can be integrated into a recombinant expression vector which ensures good expression in a host cell. Thus, in some embodiments, the present disclosure provides, an expression vector comprising a polynucleotide comprising at least one nucleic acid sequence selected from the nucleic acid sequences consisting of (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 and SEQ. ID. NO: 766;

(b) a nucleic acid sequence that is substantially identical to any one of the nucleic acid sequences of (a);
(c) a nucleic acid sequence that is substantially identical to any one of the nucleic acid sequences of (a) but for the degeneration of the genetic code;
(d) a nucleic acid sequence that is complementary to any one of the nucleic acid sequences of (a);
(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46,
SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;
(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID NO: 94, SEQ. ID NO: 95, SEQ. ID NO: 96, SEQ. ID NO: 97, SEQ. ID NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and
(g) a nucleic acid sequence that hybridizes under stringent conditions to any one of the nucleic acid sequences set forth in (a), (b), (c), (d), (e) or (f).

In some embodiments, the expression vector comprises a polynucleotide comprising 2, 3, 4, 5, 6, 7, 8, 9, 10 or more of the foregoing nucleic acid sequences.

In some embodiments, the expression vector comprises a polynucleotide comprising two nucleic acid sequences (i) and (ii), selected from the group consisting of
(a) (i) either SEQ. ID NO: 6 or SEQ. ID NO 372, and (ii) SEQ. ID NO: 384, SEQ. ID NO: 902 or SEQ. ID NO: 903;
(b) (i) a nucleic acid sequence substantially identical to either SEQ. ID NO: 6 or SEQ. ID NO 372, and (ii) a nucleic acid sequence substantially identical to SEQ. ID NO: 384, SEQ. ID NO: 902 or SEQ. ID NO: 903;
(c) (i) a nucleic acid sequence substantially identical to either SEQ. ID NO: 6 or SEQ. ID NO 372, and (ii) a nucleic acid sequence substantially identical to SEQ. ID NO: 384, SEQ. ID NO: 902 or SEQ. ID NO: 903, but for the degeneration of the genetic code;
(d) (i) a nucleic acid sequence complementary to either SEQ. ID NO: 6 or SEQ. ID NO 372, and (ii) a nucleic acid sequence complementary to SEQ. ID NO: 384, SEQ. ID NO: 902 or SEQ. ID NO: 903;
(e) (i) a nucleic acid sequence encoding a polypeptide comprising either SEQ. ID NO: 29 or SEQ. ID NO: 900, and (ii) a nucleic acid sequence encoding a polypeptide comprising SEQ. ID NO: 779 or SEQ. ID NO: 901;
(f) (i) a nucleic acid sequence encoding a polypeptide that is a functional variant of a polypeptide comprising either SEQ. ID NO: 29 or SEQ. ID NO: 900, and (ii) a nucleic acid sequence encoding a polypeptide that is a functional variant of a polypeptide comprising SEQ. ID NO: 779 or SEQ. ID NO: 901; and
(g) (i) a nucleic acid sequence hybridizing to any of the nucleic acid sequences of (a)(i), (b)(i), (c)(i), (d)(i), (e)(i) or (f)(i), and a nucleic acid sequence hybridizing to any of the nucleic acid sequences of (a)(ii), (b)(ii), (c)(ii), (d)(ii), (e)(ii) or (f)(ii).

In some embodiments, the expression vector further comprises polynucleotide elements capable of controlling expression of the polynucleotide in a cell, wherein the expression vector is suitable for expression in a host cell. The term "suitable for expression in a host cell" means that the recombinant expression vector comprises the polynucleotide of the present disclosure linked to genetic elements required to achieve expression in a host cell. Genetic elements that may be included in the expression vector in this regard include a transcriptional termination region, one or more nucleic acid sequences encoding marker genes, one or more origins of replication and the like.

Of particular interest are vectors suitable for expression in a plant cell. Recombinant vectors suitable for the introduction of nucleic acid sequences into plants include *Agrobacterium* and *Rhizobium* based vectors, such as the Ti and Ri plasmids, including for example pBIN19 (Bevan, 1984, Nucl. Acid. Res., 22: 8711-8721), pGKB5 (Bouchez et al., 1993, C R Acad. Sci. Paris, Life Sciences, 316:1188-1193), the pCGN series of binary vectors (McBride and Summerfelt, 1990, Plant Mol. Biol., 14:269-276) and other binary vectors (e.g. U.S. Pat. No. 4,940,838). Further specific vectors and methodologies may be found in Guernieau et al., 1993, Plant transformation and expression vectors In: Plant Molecular Biology Labfax (Croy R R D ed), Oxford, BIOS Scientific Publishers, pp 121-148.

In some embodiments, microbial vectors are used. For example, when *Escherichia coli* is used as a host cell, vectors such as pBR322, the pUC series of vectors, the M13 mp series of vectors, pBluescript etc. can be used.

Pursuant to the present disclosure the expression vector can further contain a marker gene. Marker genes that can be used in accordance with the present disclosure include all genes that allow the distinction of transformed cells from non-transformed cells, including all selectable and screenable marker genes. A marker gene can be a resistance marker such as an antibiotic resistance marker against, for example, kanamycin, ampicillin, or herbicide resistance markers such as, for example, hygromycin, phosphinotricin, gentamycin, spectinomycin and glyphosate. Screenable markers that can be employed to identify transformants through visual inspection include β-glucuronidase (GUS) (U.S. Pat. Nos. 5,268,463 and 5,599,670) and green fluorescent protein (GFP) (Niedz et al., 1995, Plant Cell Rep., 14: 403).

The expression vectors of the present disclosure can be prepared in accordance with methodologies well known to those skilled in the art. Such preparation can involve the bacterial species *E. coli* as an intermediary cloning host. The preparation of the *E. coli* vectors as well as the plant transformation vectors can be accomplished using commonly known techniques such as restriction digestion, ligation, gel electrophoresis, DNA sequencing, the Polymerase Chain Reaction (PCR) and other methodologies.

In accordance herewith, the expression vectors of the present disclosure can be introduced in a host cell and the host cell can be propagated by growth and culture of the cells. Techniques to introduce a vector in a host cell can vary and include transformation and transfection of host cells. Specific methodologies are well known to the art and include, electroporation; chemically mediated techniques, for example CaCl$_2$ mediated polynucleotide uptake; particle bombardment (biolistics); the use of naturally infective polynucleotides, for example, in embodiments where plant cells are selected, virally derived polynucleotides, or *Agrobacterium* or *Rhizobium* derived polynucleotides; polyethylene glycol (PEG) mediated polynucleotide uptake; microinjection; and the use of silicone carbide whiskers. Further guidance on various techniques for the transformation of plant cells can, for example, be found in the following: biolistics (Sanford, 1988, Trends in Biotechn. 6:299-302); electroporation (Fromm et al., 1985, Proc. Natl. Acad. Sci. USA., 82:5824-5828); PEG mediated DNA uptake (Potrykus et al., 1985, Mol. Gen. Genetics, 199:169-177); microinjection (Reich et al., 1986, Bio/Techn. 4:1001-1004); and silicone carbide whiskers (Kaeppler et al., 1990, Plant Cell Rep., 9:415-418) or in planta transformation using, for example, a flower dipping methodology (Clough and Bent, 1998, Plant J., 16:735-743). Methods for transforming *Papaver somniferum* are described, for example, by Yoshimatsu et al., 1992, Plant Cell Reports; 11 (3): 132-136.

Typically in embodiments where microbial cells, such as *E. coli* cells or yeast cells, are used, they are cultured using techniques generally known to a person of skill in the art. It will be further be appreciated by a person of skill in the art that such techniques generally will vary depending on the microbial host cell selected. In general, microbial host cells will be grown in a liquid medium comprising a carbon source, typically a sugar, oil or fat, a nitrogen source, typically in the form of an organic nitrogen source, such as a yeast extract, and/or a salt, such as an ammonium salt, trace elements, such as manganese, zinc, iron, and magnesium, and in some instances vitamins, all of which may be provided continuously or in batches. Growth conditions can further vary with respect to variety of growth parameters, including, for example, temperature, typically between 10° C. and 90° C., the presence or oxygen, pH, all of which may be kept constant or varied.

Where multicellular organisms, such as plants are used tissue culture techniques can be used to regenerate and grow mature plants comprising the polynucleotides of the present disclosure. Techniques can vary depending on the plant species selected. Following transformation, the plant cells can be grown and upon the emergence of differentiating tissue, such as shoots and roots, mature plants can be regenerated. Typically a plurality of plants is regenerated. Methodologies to regenerate plants are generally plant species and cell type dependent and will be known to those skilled in the art. Further guidance with respect to plant tissue culture can be found in, for example: Plant. Cell and Tissue Culture, 1994, Vasil and Thorpe Eds., Kluwer Academic Publishers; and in: Plant Cell Culture Protocols (Methods in Molecular Biology 111), 1999, Hall Eds, Humana Press.

Further, general guidance with respect to the preparation of recombinant vectors and propagation and growth of recombinant organisms in general can be found in, for example: Sambrook et al., Molecular Cloning, a Laboratory Manual, Cold Spring Harbor Laboratory Press, 2001, Third Ed.

The host cells that can be used in accordance herewith include any host cells, including, without limitation any microbial cells, including, without limitation, any bacterial, yeast, or other fungal cells; any plant cells; any animal cells; or any synthetic cells.

In some embodiments, the host cell is a plant cell obtainable or obtained from a plant belonging to the family of Papaveraceae.

In some embodiments, the host cell is a plant cell obtainable or obtained from a plant belonging to the genus *Papaver*.

In some embodiments, the host cell is a plant cell obtainable or obtained from a plant belonging to the species *Papaver somniferum, Papaver bracteatum, Papaver nudicale, Papaver orientale* or *Papaver rhoeas*.

In some embodiments, the host cell is a microbial cell obtainable or obtained from a microbial organism belonging to the species *Saccharomyces cerevisiae* or *Yarrowia lipolytica*.

In some embodiments, the host cell is a microbial cell obtainable or obtained from a microbial organism belonging to the species *Escherichia coli*.

Further included in the present disclosure is a host cell wherein the host cell comprises a polynucleotide of the present disclosure. Accordingly the present disclosure further comprises a host cell comprising a polynucleotide comprising a nucleic acid sequence selected from the nucleic acid sequences consisting of (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92; SEQ. ID NO: 93, SEQ. ID NO: 113 to SEQ. ID NO: 505 and SEQ. ID. NO: 766;

(b) a nucleic acid sequence that is substantially identical to any one of the nucleic acid sequences of (a);

(c) a nucleic acid sequence that is substantially identical to any one of the nucleic acid sequences of (a) but for the degeneration of the genetic code;

(d) a nucleic acid sequence that is complementary to any one of the nucleic acid sequences of (a);

(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(g) a nucleic acid sequence that hybridizes under stringent conditions to any one of the nucleic acid sequences set forth in (a), (b), (c), (d), (e) or (f).

In some embodiments, the host cell comprises two nucleic acid sequences (i) and (ii) selected from the group of nucleic acid sequences consisting of (a) (i) either SEQ. ID NO: 6 or SEQ. ID NO: 372, and (ii) SEQ. ID NO: 384, SEQ. ID NO: 902 or SEQ. ID NO: 903;

(b) (i) a nucleic acid sequence substantially identical to either SEQ. ID NO: 6 or SEQ. ID NO: 372, and (ii) a nucleic acid sequence substantially identical to SEQ. ID NO: 384, SEQ. ID NO: 902 or SEQ. ID NO: 903;

(c) (i) a nucleic acid sequence substantially identical to either SEQ. ID NO: 6 or SEQ. ID NO: 372 but for the degeneration of the genetic code, and (ii) a nucleic acid sequence substantially identical to SEQ. ID NO: 384, SEQ. ID NO: 902 or SEQ. ID NO: 903, but for the degeneration of the genetic code;

(d) (i) a nucleic acid sequence complementary to either SEQ. ID NO: 6 or SEQ. ID NO: 372, and (ii) a nucleic acid sequence complementary to SEQ. ID NO: 384, SEQ. ID NO: 902 or SEQ. ID NO: 903;

(e) (i) a nucleic acid sequence encoding a polypeptide comprising SEQ. ID NO: 29 or SEQ. ID NO: 900, and (ii) a nucleic acid sequence encoding a polypeptide comprising SEQ. ID NO: 779 or SEQ. ID NO: 901;

(f) (i) a nucleic acid sequence encoding a polypeptide that is a functional variant of a polypeptide comprising either SEQ. ID NO: 29 or SEQ. ID NO: 900, and (ii) a nucleic acid sequence encoding a polypeptide that is a functional variant of a polypeptide comprising SEQ. ID NO: 779 or SEQ. ID NO: 901; and (g) (i) a nucleic acid sequence hybridizing to any of the nucleic acid sequences of (a)(i), (b)(i), (c)(i), (d)(i), (e)(i) or (f)(i), and a nucleic acid sequence hybridizing to any of the nucleic acid sequences of (a)(ii), (b)(ii), (c)(ii), (d)(ii), (e)(ii) or (f)(ii).

In some embodiments, the nucleic acid sequences (i) and (ii) are linked via a polynucleotide. In other embodiments, the nucleic acid sequences (i) and (ii) are not linked via a polynucleotide.

In some embodiments, the host cell comprises two expression vectors, a first expression vector comprising nucleic acid sequence (i) and a second expression vector comprising nucleic acid (ii).

In some embodiments, the host cell does not naturally contain the polynucleotide. In other embodiments, the host cell naturally contains the polynucleotide, however the expression characteristics of the naturally present polynucleotide are suboptimal. For example, the levels of expression of a polypeptide encoded by the polynucleotide are undesirable, and thus the host cells of the present disclosure comprise levels of expression of a polypeptide encoded by a polynucleotide wherein the levels of expression of the polypeptide are modulated relative to the levels of expression of the polypeptide in natural host cells.

In some embodiments, the host cell is a microbial cell, including, without limitation, a bacterial, yeast, or other fungal cell; a plant cell; an animal cell; or a synthetic cell.

In some embodiments, the host cell is a plant cell obtainable or obtained from a plant belonging to the family of Papaveraceae.

In some embodiments, the host cell is a plant cell obtainable or obtained from a plant belonging to the genus *Papaver*.

In some embodiments, the host cell is a plant cell obtainable or obtained from a plant belonging to the species *Papaver somniferum, Papaver bracteatum, Papaver nudicale, Papaver orientale* or *Papaver rhoeas*.

In some embodiments, the host cell comprises modulated levels of an alkaloid when compared to a host cell not comprising the polynucleotide. In some embodiments, the host cell comprises a higher concentration of an alkaloid. In other embodiments, the host cell comprises a lower concentration of an alkaloid.

In some embodiments, the present disclosure provides a composition comprising a polypeptide expressed by a polynucleotide of the present disclosure. Accordingly, the present disclosure provides, in at least one embodiment, an isolated polypeptide having a amino acid sequence set forth in: SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901.

In one embodiment, the present disclosure provides a functional variant of a polypeptide having an amino acid sequence set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID. NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112 SEQ. ID NO: 506 to SEQ. ID NO: 765 or SEQ. ID NO: 768 to SEQ. ID NO: 901.

Uses of the Polynucleotides and Polypeptides of the Present Disclosure

The polynucleotides and polypeptides of the present disclosure may be used in a variety of ways.

In one aspect the polynucleotides and polypeptides of the present disclosure may be used to produce an alkaloid. Hence, in a further embodiment, the present disclosure provides, a use of a polypeptide encoded by a nucleic acid sequence selected from the nucleic acid sequences consisting of (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 and SEQ. ID. NO: 766;

(b) a nucleic acid sequence that is substantially identical to any one of the nucleic acid sequences of (a);

(c) a nucleic acid sequence that is substantially identical to any one of the nucleic acid sequences of (a) but for the degeneration of the genetic code;

(d) a nucleic acid sequence that is complementary to any one of the nucleic acid sequences of (a);

(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID NO: 39, SEQ. ID NO: 40, SEQ. ID NO: 41, SEQ. ID NO: 42, SEQ. ID NO: 43, SEQ. ID NO: 44, SEQ. ID NO: 45, or SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

and (g) a nucleic acid sequence that hybridizes under stringent conditions to any one of the nucleic acid sequences set forth in (a), (b), (c), (d), (e) or (f);

to make an alkaloid compound.

In some embodiments, the alkaloid is selected from the group consisting of (S)-norcoclaurine, (S)-coclaurine, (S)—N-methylcoclaurine, (S)-3'-hydroxy-N-methylcoclaurine, (S)-reticuline, (R)-reticuline, salutaridine, salutaridinol, thebaine, oripavine, morphinone, codeinone, codeine and morphine.

In one embodiment, the present disclosure further provides, a use of a polypeptide encoded by a nucleic acid sequence selected from the nucleic acid sequences consisting of (a) SEQ. ID NO: 75, SEQ. ID NO: 76, SEQ. ID. NO: 77, SEQ. ID NO: 78, SEQ. ID NO: 79, SEQ. ID NO: 80, SEQ. ID. NO: 81, SEQ. ID NO: 82, SEQ. ID NO: 83, and SEQ. ID. NO: 84; SEQ. ID NO: 85, SEQ. ID NO: 86, SEQ. ID. NO: 87, SEQ. ID NO: 88, SEQ. ID NO: 89, SEQ. ID NO: 90, SEQ. ID. NO: 91, SEQ. ID NO: 92, SEQ. ID NO: 93, SEQ. ID NO: 113 to SEQ. ID NO: 505 and SEQ. ID. NO: 766;

(b) a nucleic acid sequence that is substantially identical to any one of the nucleic acid sequences of (a);

(c) a nucleic acid sequence that is substantially identical to any one of the nucleic acid sequences of (a) but for the degeneration of the genetic code;

(d) a nucleic acid sequence that is complementary to any one of the nucleic acid sequences of (a);

(e) a nucleic acid sequence encoding a polypeptide having any one of the amino acid sequences set forth in SEQ. ID NO: 94, SEQ. ID NO: 95, SEQ. ID. NO: 96, SEQ. ID NO: 97, SEQ. ID NO: 98, SEQ. ID NO: 99, SEQ. ID. NO: 100, SEQ. ID NO: 101, SEQ. ID NO: 102, SEQ. ID NO: 103, SEQ. ID NO: 104, SEQ. ID NO: 105, SEQ. ID. NO: 106, SEQ. ID NO: 107, SEQ. ID NO: 108, SEQ. ID NO: 109, SEQ. ID. NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 94, SEQ. ID NO: 95, SEQ. ID. NO: 96, SEQ. ID NO: 97, SEQ. ID NO: 98, SEQ. ID NO: 99, SEQ. ID. NO: 100, SEQ. ID NO: 101, SEQ. ID NO: 102, SEQ. ID NO: 103, SEQ. ID NO: 104, SEQ. ID NO: 105, SEQ. ID. NO: 106, SEQ. ID NO: 107, SEQ. ID NO: 108, SEQ. ID NO: 109, SEQ. ID. NO: 110, SEQ. ID NO: 111, SEQ. ID NO: 112, SEQ. ID NO: 506 to SEQ. ID NO: 765 or SEQ. ID NO: 768 to SEQ. ID NO: 901; and (g) a nucleic acid sequence that hybridizes under stringent conditions to any one of the nucleic acid sequences set forth in (a), (b), (c), (d), (e) or (f);

to make (R)-reticuline or an (R)-reticuline pathway-precursor, wherein the (R)-reticuline precursor has the chemical formula (I):

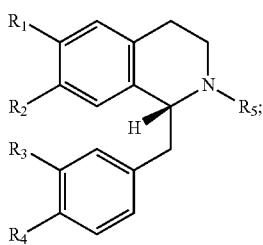

wherein $R_1$ is an hydroxyl or a methoxy group; $R_2$ is a hydroxyl group; $R_3$ is a hydroxyl group or a hydrogen atom; $R_4$ is a hydroxyl group or a methoxy group and $R_5$ is a methyl group or a hydrogen atom.

In some embodiments, the (R)-reticuline pathway precursor is selected from (S)-norcoclaurine; (S)-coclaurine; (S)—N-methylcoclaurine; (S)-3'-hydroxy-N-methylcoclaurine; or (S)-reticuline.

In one embodiment, the present disclosure further provides, a use of a polypeptide encoded by a nucleic acid sequence selected from the nucleic acid sequences consisting of (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, and SEQ. ID NO: 60;

(b) a nucleic acid sequence that is substantially identical to any one of the nucleic acid sequences of (a);

(c) a nucleic acid sequence that is substantially identical to any one of the nucleic acid sequences of (a) but for the degeneration of the genetic code;

(d) a nucleic acid sequence that is complementary to any one of the nucleic acid sequences of (a);

(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, and SEQ. ID NO: 74;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, and SEQ. ID NO: 74; and (g) a nucleic acid sequence that hybridizes under stringent conditions to any one of the nucleic acid sequences set forth in (a), (b), (c), (d), (e) or (f);

to make an opiate alkaloid.

In some embodiments, the opiate alkaloid has the chemical formula (II):

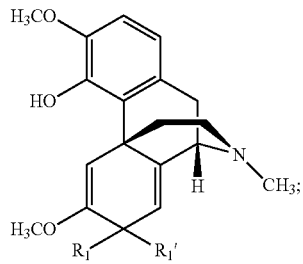

wherein $R_1$ is an hydroxyl group and $R_1'$ is a hydrogen atom, or wherein $R_1$ and $R_1'$ taken together are an oxo group.

In some embodiments, the opiate alkaloid has the chemical formula (III):

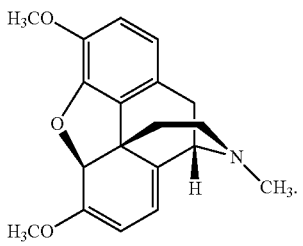

In some embodiments, the opiate alkaloid has the chemical formula (IV):

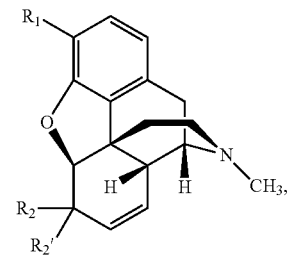

wherein $R_1$ is an hydroxyl group or a methoxy group; and $R_2$ is a hydroxyl group and $R_2'$ is a hydrogen atom; or $R_2$ and $R_2'$ taken together are an oxo group.

In some embodiments, the opiate alkaloid is selected from the group consisting of salutaridine; salutaridinol; thebaine, oripavine, morphinone; codeinone; codeine and morphine.

In one embodiment, the present disclosure further provides, a use of a polypeptide encoded by a nucleic acid sequence selected from the nucleic acid sequences consisting of (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, SEQ. ID NO: 23, (b) a nucleic acid sequence that is substantially identical to any one of the nucleic acid sequences of (a);
(c) a nucleic acid sequence that is substantially identical to any one of the nucleic acid sequences of (a) but for the degeneration of the genetic code;
(d) a nucleic acid sequence that is complementary to any one of the nucleic acid sequences of (a);
(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, and SEQ. ID NO: 46;
(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, and SEQ. ID NO: 46; and
(g) a nucleic acid sequence that hybridizes under stringent conditions to any one of the nucleic acid sequences set forth in (a), (b), (c), (d), (e) or (f);

to make an opiate alkaloid having the chemical formula (II):

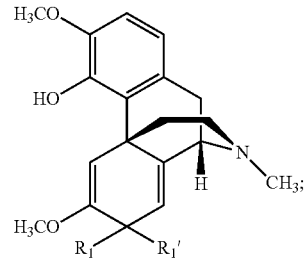

wherein $R_1$ is an hydroxyl group and $R_1'$ is a hydrogen atom, or wherein $R_1$ and $R_1'$ taken together are an oxo group; or an opiate alkaloid having the chemical formula (III):

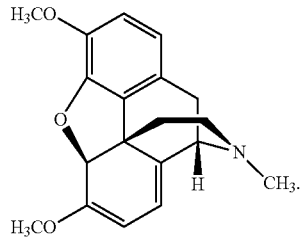

In one embodiment, the present disclosure further provides, a use of a polypeptide encoded by a nucleic acid sequence selected from the nucleic acid sequences consisting of (a) SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, and SEQ. ID NO: 60;

(b) a nucleic acid sequence that is substantially identical to any one of the nucleic acid sequences of (a);

(c) a nucleic acid sequence that is substantially identical to any one of the nucleic acid sequences of (a) but for the degeneration of the genetic code;

(d) a nucleic acid sequence that is complementary to any one of the nucleic acid sequences of (a);

(e) a nucleic acid sequence encoding a polypeptide having any one of the amino acid sequences set forth in SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, and SEQ. ID NO: 74;

(f) a nucleic acid sequence that encodes a functional variant of any one of the amino acid sequences set forth in SEQ. ID NO: 61 SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, and SEQ. ID NO: 74, SEQ. ID NO: 75; and (g) a nucleic acid sequence that hybridizes under stringent conditions to any one of the nucleic acid sequences set forth in (a), (b), (c), (d), (e) or (f);

to make an opiate alkaloid wherein the opiate alkaloid the chemical formula (IV):

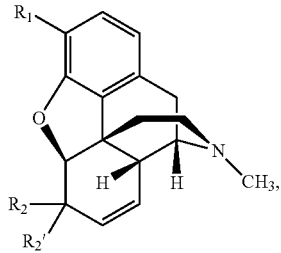

(IV)

wherein $R_1$ is an hydroxyl group or a methoxy group; and $R_2$ is a hydroxyl group and $R_2'$ is a hydrogen atom; or $R_2$ and $R_2'$ taken together are an oxo group.

In one embodiment, the present disclosure further provides, a use of a first polypeptide and a second polypeptide encoded by a first and second nucleic acid sequence (i) and (ii) selected from the group consisting of (a) (i) either SEQ. ID NO: 6 or SEQ. ID NO: 372, and (ii) SEQ. ID NO: 384, SEQ. ID NO: 902 or SEQ. ID NO: 903;

(b) (i) a nucleic acid sequence substantially identical to either SEQ. ID NO: 6 or SEQ. ID NO: 372, and (ii) a nucleic acid sequence substantially identical to SEQ. ID NO: 384, SEQ. ID NO: 902 or SEQ. ID NO: 903;

(c) (i) a nucleic acid sequence substantially identical to either SEQ. ID NO: 6 or SEQ. ID NO: 372 but for the degeneration of the genetic code, and (ii) a nucleic acid sequence substantially identical to SEQ. ID NO: 384, SEQ. ID NO: 902 or SEQ. ID NO: 903, but for the degeneration of the genetic code;

(d) (i) a nucleic acid sequence complementary to either SEQ. ID NO: 6 or SEQ. ID NO: 372, and (ii) a nucleic acid sequence complementary to SEQ. ID NO: 384, SEQ. ID NO: 902 or SEQ. ID NO: 903;

(e) (i) a nucleic acid sequence encoding a polypeptide comprising SEQ. ID NO: 29 or SEQ. ID NO: 900, and (ii) a nucleic acid sequence encoding a polypeptide comprising SEQ. ID NO: 779 or SEQ. ID NO: 901;

(f) (i) a nucleic acid sequence encoding a polypeptide that is a functional variant of a polypeptide comprising SEQ. ID NO: 29 or SEQ. ID NO: 900, and (ii) a nucleic acid sequence encoding a polypeptide that is a functional variant of a polypeptide comprising SEQ. ID NO: 779 or SEQ. ID NO: 901; and (g) (i) a nucleic acid sequence hybridizing to any of the nucleic acid sequences of (a)(i), (b)(i), (c)(i), (d)(i), (e)(i) or (f)(i), and (ii) a nucleic acid sequence hybridizing to any of the nucleic acid sequences of (a)(ii), (b)(ii), (c)(ii), (d)(ii), (e)(ii) or (f)(ii).

to make thebaine.

In some embodiments, the polynucleotides of the present disclosure are used to examine the presence of the polynucleotides in a cell or cell extract.

In some embodiments, the polynucleotides of the present disclosure are used to modulate the expression of the polynucleotides in a cell.

In some embodiments, the polynucleotides and polypeptides are used for the in vitro production of alkaloids.

In some embodiments, the polynucleotides and polypeptides are used for the in vivo production of alkaloids.

In one embodiment, a polypeptide of the present disclosure is used to mediate a reaction in which a first alkaloid is converted to form a second alkaloid.

In one embodiment, a polypeptide of the present disclosure is an enzyme used to catalyze a reaction in which a first alkaloid is converted to form a second alkaloid.

In one embodiment, a polypeptide comprising or consisting of an amino acid sequence set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 11, SEQ. ID NO: 506 to SEQ. ID NO: 765 or SEQ. ID NO: 768 to SEQ. ID NO: 901 is used to mediate a reaction in which a first alkaloid is converted to form a second alkaloid.

In another embodiment, a polypeptide comprising or consisting of a functional variant of a polypeptide having an amino acid sequence set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901 is used to mediate a reaction in which a first alkaloid is converted to form a second alkaloid.

In one embodiment, the polypeptide is selected from at least one polypeptide having an amino acid sequence set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, to SEQ. ID NO: 46 and the first alkaloid is (R)-Reticuline and the second alkaloid is selected from salutaridine, salutaridinol and thebaine.

In one embodiment, a first polypeptide is selected from SEQ. ID NO: 29 or SEQ. ID NO: 900, and a second polypeptide is SEQ ID NO: 779 or SEQ. ID NO: 901 and the first alkaloid is (R)-Reticuline and the second alkaloid is thebaine.

In one embodiment, the polypeptide is selected from at least one polypeptide having an amino acid sequence set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, and SEQ. ID NO: 46 and the first alkaloid is salutaridine and the second alkaloid is salutaridinol or thebaine.

In one embodiment, a first polypeptide is selected from SEQ. ID NO: 29 or SEQ. ID NO: 900, and a second polypeptide is SEQ ID NO: 779 or SEQ. ID NO: 901 and the first alkaloid is salutardine and the second alkaloid is thebaine.

In one embodiment, the polypeptide is selected from at least one polypeptide having an amino acid sequence set forth in SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, or SEQ. ID NO: 74 and the first alkaloid is thebaine and the second alkaloid is selected from codeinone, codeine and morphine.

In one embodiment, the polypeptide is selected from at least one polypeptide having an amino acid sequence set forth in SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74 and the first alkaloid is codeinone and the second alkaloid is codeine or morphine.

In one embodiment, the polypeptide is selected from at least one polypeptide having an amino acid sequence set forth in SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74 and the first alkaloid is codeine and the second alkaloid is morphine.

In one embodiment, the polypeptide is selected from at least one polypeptide having an amino acid sequence set forth in SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901 and the first alkaloid is a mixture comprising dopamine and 4-hydroxy-phenylacetaldehyde and the second alkaloid is selected from GSM norcoclaurine, (S)-coclaurine, (S)—N-methylcoclaurine, (S)-3'-hydroxy-N-methylcoclaurine, (S)-reticuline, and (R)-reticuline).

In one embodiment, the polypeptide is selected from at least one polypeptide having an amino acid sequence set forth in SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901 and the first alkaloid is (S)-norcoclaurine, and the second alkaloid is selected from (S)-coclaurine, (S)—N-methylcoclaurine, (S)-3'-hydroxy-N-methylcoclaurine, (S)-reticuline, and (R)-reticuline).

In one embodiment, the polypeptide is selected from at least one polypeptide having an amino acid sequence set forth in SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901. and the first alkaloid is (S)-coclaurine, and the second alkaloid is selected from (S)—N-methylcoclaurine, (S)-3'-hydroxy-N-methylcoclaurine, (S)-reticuline, and (R)-reticuline).

In one embodiment, the polypeptide is selected from at least one polypeptide having an amino acid sequence set forth in SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901 and the first alkaloid is (S)—N-methylcoclaurine, and the second alkaloid is selected from (S)-3'-hydroxy-N-methylcoclaurine, (S)-reticuline, and (R)-reticuline.

In one embodiment, the polypeptide is selected from at least one polypeptide having an amino acid sequence set forth in SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901 and the first alkaloid is (S)-3'-hydroxy-N-methylcoclaurine and the second alkaloid is (S)-reticuline, or (R)-reticuline.

In one embodiment, the polypeptide is selected from at least one polypeptide having an amino acid sequence set forth in SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901 and the first alkaloid is (S)-reticuline, and the second alkaloid is (R)-reticuline.

In one embodiment, a polynucleotide comprising SEQ. ID NO: 1 encodes a polypeptide having reticuline epimerase activity.

In one embodiment, a polynucleotide comprising SEQ. ID NO: 2 encodes a polypeptide having salutaridine synthase activity.

In one embodiment, a polynucleotide comprising SEQ. ID NO: 3 encodes a polypeptide having O-methyl transferase activity.

In one embodiment, a polynucleotide comprising SEQ. ID NO: 4 encodes a polypeptide having salutaridinol 7 acetyl transferase activity.

In one embodiment, a polynucleotide comprising SEQ. ID NO: 5 encodes a polypeptide having salutaridine reductase activity.

In one embodiment, a polynucleotide comprising SEQ. ID NO: 6 encodes a polypeptide having pathogenesis related protein activity.

In one embodiment, a polynucleotide comprising SEQ. ID NO: 7 encodes a polypeptide having purine permease activity.

In one embodiment, a polynucleotide comprising SEQ. ID NO: 9 encodes a polypeptide having cytochrome P450 or methylstylopine 14-hydroxylase activity.

In one embodiment, a polynucleotide comprising SEQ. ID NO: 10 encodes a polypeptide having prohibitin related membrane protease subunit activity.

In one embodiment, a polynucleotide comprising SEQ. ID NO: 11 encodes a polypeptide having starch synthase activity.

In one embodiment, a polynucleotide comprising SEQ. ID NO: 12 encodes a polypeptide having transposase activity.

In one embodiment, a polynucleotide comprising SEQ. ID NO: 14 encodes a polypeptide having protein kinase activity.

In one embodiment, a polynucleotide comprising SEQ. ID NO: 15 encodes a polypeptide having retrotransposon reverse transcriptase activity.

In one embodiment, a polynucleotide comprising SEQ. ID NO: 16 encodes a polypeptide having a defect in meristem silencing activity.

In one embodiment, a polynucleotide comprising SEQ. ID NO: 17 encodes a polypeptide having retrovirus polyprotein activity.

In one embodiment, a polynucleotide comprising SEQ. ID NO: 18 encodes a polypeptide having disease resistance activity.

In one embodiment, a polynucleotide comprising SEQ. ID NO: 19 encodes a polypeptide having polymerase transcriptional ii coactivator activity.

In one embodiment, a polynucleotide comprising SEQ. ID NO: 22 encodes a polypeptide having glutamine synthetase activity.

In one embodiment, a polynucleotide comprising SEQ. ID NO: 23 encodes a polypeptide having disease resistance activity.

In one embodiment, a polynucleotide comprising SEQ. ID NO: 47 encodes a polypeptide having GDT1-lihe protein 3 activity.

In one embodiment, a polynucleotide comprising SEQ. ID NO: 48 encodes a polypeptide having thebaine 6-O-demethylase activity.

In one embodiment, a polynucleotide comprising SEQ. ID NO: 49 encodes a polypeptide having dehydroshinganine reductase activity.

In one embodiment, a polynucleotide comprising SEQ. ID NO: 50 encodes a polypeptide having carbon carbolite repressor activity.

In one embodiment, a polynucleotide comprising SEQ. ID NO: 51 encodes a polypeptide having peptidyl-t-RNA hydrolase activity.

In one embodiment, a polynucleotide comprising SEQ. ID NO: 52 encodes a polypeptide having NADPH-dependent codeinone reductase activity.

In one embodiment, a polynucleotide comprising SEQ. ID NO: 53 encodes a polypeptide having homeobox protein knotted-1-like activity.

In one embodiment, a polynucleotide comprising SEQ. ID NO: 54 encodes a polypeptide having cytochrome b6 activity.

In one embodiment, a polynucleotide comprising SEQ. ID NO: 55 encodes a polypeptide having aminoacrylate hydrolase activity.

In one embodiment, a polynucleotide comprising SEQ. ID NO: 56 encodes a polypeptide having pentatricopeptide repeat containing protein activity.

In one embodiment, a polynucleotide comprising SEQ. ID NO: 57 encodes a polypeptide having vascular protein sorting associated protein activity.

In one embodiment, a polynucleotide comprising SEQ. ID NO: 58 encodes a polypeptide having polyadenylate-binding protein interacting protein activity.

In one embodiment, a polynucleotide comprising SEQ. ID NO: 59 encodes a polypeptide having NADPH codeinone reductase activity.

In one embodiment, a polynucleotide comprising SEQ. ID NO: 60 encodes a polypeptide having NADPH codeinone-O-demethylase activity.

In one embodiment, a polynucleotide comprising SEQ. ID NO: 96 encodes a polypeptide having serine/threonine protein kinase activity.

In one embodiment, a polynucleotide comprising SEQ. ID NO: 100 encodes a polypeptide having 6-O-methyltransferase activity.

In one embodiment, a polynucleotide comprising SEQ. ID NO: 101 encodes a polypeptide having fimbrin activity.

In one embodiment, a polynucleotide comprising SEQ. ID NO: 102 encodes a polypeptide having N-methyltransferase activity.

In one embodiment, a polynucleotide comprising SEQ. ID NO: 104 encodes a polypeptide having cytosine-5-methyltransferase activity.

In one embodiment, a polynucleotide comprising SEQ. ID NO: 106 encodes a polypeptide having pentatricopeptide activity.

In one embodiment, a polynucleotide comprising SEQ. ID NO: 109 encodes a polypeptide having 4'-O-methyltransferase activity.

In one embodiment, a polynucleotide comprising SEQ. ID NO: 110 encodes a polypeptide having 4'-O-methyltransferase activity.

In one embodiment, a polynucleotide comprising SEQ. ID NO: 111 encodes a polypeptide having CYP80B3 activity.

In one embodiment, a polynucleotide comprising SEQ. ID NO: 112 encodes a polypeptide having MACP1

In one embodiment, a polynucleotide comprising SEQ. ID NO: 113 encodes a polypeptide having retrotransposable activity.

In one embodiment, a polynucleotide comprising SEQ. ID NO: 114 encodes a polypeptide having ATP-dependent Clp protease ATP-binding subunit activity.

In one embodiment, a polynucleotide comprising SEQ. ID NO: 116 encodes a polypeptide having UV-stimulated scaffold protein A activity.

In one embodiment, a polynucleotide comprising SEQ. ID NO: 118 encodes a polypeptide having serine-tRNA ligase activity.

In one embodiment, a polynucleotide comprising SEQ. ID NO: 120 encodes a polypeptide having receptor-like protein kinase activity.

In one embodiment, a polynucleotide comprising SEQ. ID NO: 121 encodes a polypeptide having DNA polymerase V activity.

In one embodiment, a polynucleotide comprising SEQ. ID NO: 122 encodes a polypeptide having oligopeptidase activity.

In one embodiment, a polynucleotide comprising SEQ. ID NO: 127 encodes a polypeptide having heme-binding protein activity activity.

In one embodiment, a polynucleotide comprising SEQ. ID NO: 133 encodes a polypeptide having GTP-binding nuclear protein activity.

In one embodiment, a polynucleotide comprising SEQ. ID NO: 136 encodes a polypeptide having RNA pseudouridine synthase activity.

In one embodiment, a polynucleotide comprising SEQ. ID NO: 138 encodes a polypeptide having cinnamyl alcohol dehydrogenase activity.

In one embodiment, a polynucleotide comprising SEQ. ID NO: 142 encodes a polypeptide having Retrovirus-related Pol polyprotein activity.

In one embodiment, a polynucleotide comprising SEQ. ID NO: 143 encodes a polypeptide having reticulon activity.

In one embodiment, a polynucleotide comprising SEQ. ID NO: 144 encodes a polypeptide having oxidoreductase activity.

In one embodiment, a polynucleotide comprising SEQ. ID NO: 148 encodes a polypeptide having mitotic-specific cyclin activity.

In one embodiment, a polynucleotide comprising SEQ. ID NO: 149 encodes a polypeptide having epidermis-specific secreted glycoprotein activity.

In one embodiment, a polynucleotide comprising SEQ. ID NO: 153 encodes a polypeptide having ribonuclease H protein activity.

In one embodiment, a polynucleotide comprising SEQ. ID NO: 154 encodes a polypeptide having transporter MCH1 activity.

In one embodiment, a polynucleotide comprising SEQ. ID NO: 155 encodes a polypeptide having RNA-binding protein activity.

In one embodiment, a polynucleotide comprising SEQ. ID NO: 156 encodes a polypeptide having F-box/kelch-repeat protein activity.

In one embodiment, a polynucleotide comprising SEQ. ID NO: 157 encodes a polypeptide having Gag-Pol polyprotein activity.

In one embodiment, a polynucleotide comprising SEQ. ID NO: 158 encodes a polypeptide having Gag-Pol polyprotein activity.

In one embodiment, a polynucleotide comprising SEQ. ID NO: 159 encodes a polypeptide having retrovirus-related Pol polyprotein activity.

In one embodiment, a polynucleotide comprising SEQ. ID NO: 160 encodes a polypeptide having protease regulatory subunit 4 homolog activity.

In one embodiment, a polynucleotide comprising SEQ. ID NO: 162 encodes a polypeptide having proteasome regulatory subunit 4 homolog B activity.

In one embodiment, a polynucleotide comprising SEQ. ID NO: 164 encodes a polypeptide having glycosyltransferase activity.

In one embodiment, a polynucleotide comprising SEQ. ID NO: 165 encodes a polypeptide having small nuclear ribonucleoprotein activity.

In one embodiment, a polynucleotide comprising SEQ. ID NO: 167 encodes a polypeptide having endo-1,3-beta-glucosidase activity.

In one embodiment, a polynucleotide comprising SEQ. ID NO: 169 encodes a polypeptide having eptidyl-prolyl cis-trans isomerase activity.

In one embodiment, a polynucleotide comprising SEQ. ID NO: 170 encodes a polypeptide having F-box/kelch-repeat protein activity.

In one embodiment, a polynucleotide comprising SEQ. ID NO: 171 encodes a polypeptide having nuclease activity.

In one embodiment, a polynucleotide comprising SEQ. ID NO: 172 encodes a polypeptide having F-box/kelch-repeat protein activity.

In one embodiment, a polynucleotide comprising SEQ. ID NO: 173 encodes a polypeptide having ankyrin repeat-containing protein activity.

In one embodiment, a polynucleotide comprising SEQ. ID NO: 174 encodes a polypeptide having ribosomal protein activity.

In one embodiment, a polynucleotide comprising SEQ. ID NO: 175 encodes a polypeptide having hypersensitive-induced response protein activity.

In one embodiment, a polynucleotide comprising SEQ. ID NO: 176 encodes a polypeptide having FRIGIDA-like protein activity.

In one embodiment, a polynucleotide comprising SEQ. ID NO: 177 encodes a polypeptide having polygalacturonase activity.

In one embodiment, a polynucleotide comprising SEQ. ID NO: 178 encodes a polypeptide having sodium/hydrogen exchanger activity.

In one embodiment, a polynucleotide comprising SEQ. ID NO: 179 encodes a polypeptide having RNA-binding protein activity.

In one embodiment, a polynucleotide comprising SEQ. ID NO: 181 encodes a polypeptide having polyribonucleotide nucleotidyltransferase 2 activity.

In one embodiment, a polynucleotide comprising SEQ. ID NO: 182 encodes a polypeptide having ribosomal protein activity.

In one embodiment, a polynucleotide comprising SEQ. ID NO: 183 encodes a polypeptide having zinc finger BED domain-containing protein RICESLEEPER activity.

In one embodiment, a polynucleotide comprising SEQ. ID NO: 184 encodes a polypeptide having translation initiation factor eIF-2B subunit alpha activity.

In one embodiment, a polynucleotide comprising SEQ. ID NO: 187 encodes a polypeptide having retrovirus-related Pol polyprotein activity.

In one embodiment, a polynucleotide comprising SEQ. ID NO: 188 encodes a polypeptide having respiratory burst oxidase homolog protein A activity.

In one embodiment, a polynucleotide comprising SEQ. ID NO: 189 encodes a polypeptide having Respiratory burst oxidase homolog protein F activity.

In one embodiment, a polynucleotide comprising SEQ. ID NO: 190 encodes a polypeptide having retrovirus-related Pol polyprotein activity.

In one embodiment, a polynucleotide comprising SEQ. ID NO: 191 encodes a polypeptide having ribonuclease H protein activity.

In one embodiment, a polynucleotide comprising SEQ. ID NO: 192 encodes a polypeptide having pentatricopeptide repeat-containing protein activity.

In one embodiment, a polynucleotide comprising SEQ. ID NO: 194 encodes a polypeptide having Pentatricopeptide repeat-containing protein activity.

In one embodiment, a polynucleotide comprising SEQ. ID NO: 199 encodes a polypeptide having transcription factor IBH1 activity.

In one embodiment, a polynucleotide comprising SEQ. ID NO: 200 encodes a polypeptide having cytosolic Fe—S cluster assembly factor narfl activity.

In one embodiment, a polynucleotide comprising SEQ. ID NO: 201 encodes a polypeptide having fimbrin-2 activity.

In one embodiment, a polynucleotide comprising SEQ. ID NO: 202 encodes a polypeptide having Gag-Pol polyprotein activity.

In one embodiment, a polynucleotide comprising SEQ. ID NO: 203 encodes a polypeptide having Gag-Pol polyprotein activity.

In one embodiment, a polynucleotide comprising SEQ. ID NO: 204 encodes a polypeptide having tripeptidyl-peptidase activity.

In one embodiment, a polynucleotide comprising SEQ. ID NO: 205 encodes a polypeptide having oxygen-independent coproporphyrinogen-III oxidase-like protein activity.

In one embodiment, a polynucleotide comprising SEQ. ID NO: 206 encodes a polypeptide having Golgi apparatus membrane protein-like protein ECHIDNA activity.

In one embodiment, a polynucleotide comprising SEQ. ID NO: 207 encodes a polypeptide having cytochrome P450 activity.

In one embodiment, a polynucleotide comprising SEQ. ID NO: 208 encodes a polypeptide having RNA-binding protein activity.

In one embodiment, a polynucleotide comprising SEQ. ID NO: 209 encodes a polypeptide having protein phosphatase 2C activity.

In one embodiment, a polynucleotide comprising SEQ. ID NO: 210 encodes a polypeptide having ACT domain-containing protein ACR4 activity.

In one embodiment, a polynucleotide comprising SEQ. ID NO: 211 encodes a polypeptide having shaggy-related protein kinase delta activity.

In one embodiment, a polynucleotide comprising SEQ. ID NO: 212 encodes a polypeptide having nuclear pore complex protein NUP35 activity.

In one embodiment, a polynucleotide comprising SEQ. ID NO: 213 encodes a polypeptide having chaperone protein DnaJ activity.

In one embodiment, a polynucleotide comprising SEQ. ID NO: 214 encodes a polypeptide having ribonuclease H protein activity.

In one embodiment, a polynucleotide comprising SEQ. ID NO: 215 encodes a polypeptide having short chain dehydrogenase/reductase activity.

In one embodiment, a polynucleotide comprising SEQ. ID NO: 216 encodes a polypeptide having retrovirus-related Pol polyprotein activity.

In one embodiment, a polynucleotide comprising SEQ. ID NO: 217 encodes a polypeptide having cytochrome b6-f complex iron-sulfur subunit 2 activity.

In one embodiment, a polynucleotide comprising SEQ. ID NO: 218 encodes a polypeptide having protein trichome birefringence-like activity.

In one embodiment, a polynucleotide comprising SEQ. ID NO: 219 encodes a polypeptide having endochitinase activity.

In one embodiment, a polynucleotide comprising SEQ. ID NO: 220 encodes a polypeptide having proteasome subunit beta type-4 activity.

In one embodiment, a polynucleotide comprising SEQ. ID NO: 221 encodes a polypeptide having 1-deoxy-D-xylulose-5-phosphate synthase activity.

In one embodiment, a polynucleotide comprising SEQ. ID NO: 222 encodes a polypeptide having phosphomethylpyrimidine synthase activity.

In one embodiment, a polynucleotide comprising SEQ. ID NO: 224 encodes a polypeptide having Ribose-phosphate pyrophosphokinase 1 activity.

In one embodiment, a polynucleotide comprising SEQ. ID NO: 225 encodes a polypeptide having Gag-Pol polyprotein activity.

In one embodiment, a polynucleotide comprising SEQ. ID NO: 227 encodes a polypeptide having nicotinamide mononucleotide adenylyltransferase activity.

In one embodiment, a polynucleotide comprising SEQ. ID NO: 228 encodes a polypeptide having LRR receptor-like serine/threonine-protein kinase activity.

In one embodiment, a polynucleotide comprising SEQ. ID NO: 230 encodes a polypeptide having AC transposase activity.

In one embodiment, a polynucleotide comprising SEQ. ID NO: 231 encodes a polypeptide having serine/threonine-protein phosphatase 7 long form activity.

In one embodiment, a polynucleotide comprising SEQ. ID NO: 232 encodes a polypeptide having bark storage protein A activity.

In one embodiment, a polynucleotide comprising SEQ. ID NO: 233 encodes a polypeptide having subtilisin-like protease activity.

In one embodiment, a polynucleotide comprising SEQ. ID NO: 234 encodes a polypeptide having retrotransposable element ORF2 protein activity.

In one embodiment, a polynucleotide comprising SEQ. ID NO: 235 encodes a polypeptide having Gag-Pol polyprotein activity.

In one embodiment, a polynucleotide comprising SEQ. ID NO: 236 encodes a polypeptide having Protein RCC2 activity.

In one embodiment, a polynucleotide comprising SEQ. ID NO: 238 encodes a polypeptide having aquaporin NIP2-1 activity.

In one embodiment, a polynucleotide comprising SEQ. ID NO: 239 encodes a polypeptide having ABC transporter C family member 8 activity.

In one embodiment, a polynucleotide comprising SEQ. ID NO: 240 encodes a polypeptide having arabinosyltransferase ARAD1 activity.

In one embodiment, a polynucleotide comprising SEQ. ID NO: 242 encodes a polypeptide having ABC transporter E family member 2 activity.

In one embodiment, a polynucleotide comprising SEQ. ID NO: 243 encodes a polypeptide having Cytochrome b6-f complex iron-sulfur subunit 2 activity.

In one embodiment, a polynucleotide comprising SEQ. ID NO: 244 encodes a polypeptide having Protein trichome birefringence-like 3 activity.

In one embodiment, a polynucleotide comprising SEQ. ID NO: 245 encodes a polypeptide having copia protein activity.

In one embodiment, a polynucleotide comprising SEQ. ID NO: 246 encodes a polypeptide having CRAL-TRIO domain-containing protein activity.

In one embodiment, a polynucleotide comprising SEQ. ID NO: 250 encodes a polypeptide having long chain acyl-CoA synthetase 8 activity.

In one embodiment, a polynucleotide comprising SEQ. ID NO: 252 encodes a polypeptide having pseudouridine-5'-phosphate glycosidase activity.

In one embodiment, a polynucleotide comprising SEQ. ID NO: 253 encodes a polypeptide having salutaridine reductase activity.

In one embodiment, a polynucleotide comprising SEQ. ID NO: 254 encodes a polypeptide having transmembrane emp24 domain-containing protein activity.

In one embodiment, a polynucleotide comprising SEQ. ID NO: 255 encodes a polypeptide having Chaperone protein DnaJ activity.

In one embodiment, a polynucleotide comprising SEQ. ID NO: 256 encodes a polypeptide having Tyrosine/DOPA decarboxylase activity.

In one embodiment, a polynucleotide comprising SEQ. ID NO: 505 encodes a polypeptide having Indole-3-glycerol phosphate synthase activity.

In one embodiment, a polynucleotide comprising SEQ. ID NO: 257 encodes a polypeptide having ubiquitin-activating enzyme activity.

In one embodiment, a polynucleotide comprising SEQ. ID NO: 258 encodes a polypeptide having retrovirus-related Pol polyprotein activity.

In one embodiment, a polynucleotide comprising SEQ. ID NO: 259 encodes a polypeptide having topoisomerase activity.

In one embodiment, a polynucleotide comprising SEQ. ID NO: 260 encodes a polypeptide having disease resistance protein activity.

In one embodiment, a polynucleotide comprising SEQ. ID NO: 262 encodes a polypeptide having Gag-Pol polyprotein activity.

In one embodiment, a polynucleotide comprising SEQ. ID NO: 263 encodes a polypeptide having endoplasmic reticulum-Golgi intermediate compartment protein activity.

In one embodiment, a polynucleotide comprising SEQ. ID NO: 264 encodes a polypeptide having ribonuclease H protein activity.

In one embodiment, a polynucleotide comprising SEQ. ID NO: 265 encodes a polypeptide having nicotinamide mononucleotide adenylyltransferase activity.

In one embodiment, a polynucleotide comprising SEQ. ID NO: 270 encodes a polypeptide having DNA-directed RNA polymerase I subunit RPA1 activity.

In one embodiment, a polynucleotide comprising SEQ. ID NO: 271 encodes a polypeptide having Tf2-9 polyprotein activity.

In one embodiment, a polynucleotide comprising SEQ. ID NO: 272 encodes a polypeptide having Tf2-9 polyprotein activity.

In one embodiment, a polynucleotide comprising SEQ. ID NO: 273 encodes a polypeptide having vesicle-associated membrane protein activity.

In one embodiment, a polynucleotide comprising SEQ. ID NO: 274 encodes a polypeptide having retrovirus-related Pol polyprotein activity.

In one embodiment, a polynucleotide comprising SEQ. ID NO: 276 encodes a polypeptide having Tf2-9 polyprotein activity.

In one embodiment, a polynucleotide comprising SEQ. ID NO: 278 encodes a polypeptide having pentatricopeptide repeat-containing protein activity.

In one embodiment, a polynucleotide comprising SEQ. ID NO: 281 encodes a polypeptide having Gag-Pol polyprotein activity.

In one embodiment, a polynucleotide comprising SEQ. ID NO: 283 encodes a polypeptide having DNA (cytosine-5)-methyltransferase activity.

In one embodiment, a polynucleotide comprising SEQ. ID NO: 290 encodes a polypeptide having ATPase activity.

In one embodiment, a polynucleotide comprising SEQ. ID NO: 291 encodes a polypeptide having polygalacturonase activity.

In one embodiment, a polynucleotide comprising SEQ. ID NO: 292 encodes a polypeptide having polygalacturonase activity.

In one embodiment, a polynucleotide comprising SEQ. ID NO: 298 encodes a polypeptide having L-type lectin-domain containing receptor kinase activity.

In one embodiment, a polynucleotide comprising SEQ. ID NO: 303 encodes a polypeptide having retrovirus-related Pol polyprotein activity.

In one embodiment, a polynucleotide comprising SEQ. ID NO: 305 encodes a polypeptide having F-box/kelch-repeat protein activity.

In one embodiment, a polynucleotide comprising SEQ. ID NO: 306 encodes a polypeptide having UDP-glycosyltransferase activity.

In one embodiment, a polynucleotide comprising SEQ. ID NO: 312 encodes a polypeptide having ribosomal protein activity.

In one embodiment, a polynucleotide comprising SEQ. ID NO: 313 encodes a polypeptide having DNA (cytosine-5)-methyltransferase activity.

In one embodiment, a polynucleotide comprising SEQ. ID NO: 316 encodes a polypeptide having Myb family transcription factor APL activity.

In one embodiment, a polynucleotide comprising SEQ. ID NO: 317 encodes a polypeptide having Phytoene dehydrogenase activity.

In one embodiment, a polynucleotide comprising SEQ. ID NO: 318 encodes a polypeptide having cis-phytoene desaturase activity.

In one embodiment, a polynucleotide comprising SEQ. ID NO: 319 encodes a polypeptide having glucan endo-1,3-beta-glucosidase activity.

In one embodiment, a polynucleotide comprising SEQ. ID NO: 320 encodes a polypeptide having ATPase activity.

In one embodiment, a polynucleotide comprising SEQ. ID NO: 321 encodes a polypeptide having feruloyl esterase A activity.

In one embodiment, a polynucleotide comprising SEQ. ID NO: 322 encodes a polypeptide having retrovirus-related Pol polyprotein activity.

In one embodiment, a polynucleotide comprising SEQ. ID NO: 326 encodes a polypeptide having cytochrome b6-f complex iron-sulfur subunit activity.

In one embodiment, a polynucleotide comprising SEQ. ID NO: 327 encodes a polypeptide having zinc finger BED domain-containing protein RICESLEEPER 2 activity.

In one embodiment, a polynucleotide comprising SEQ. ID NO: 330 encodes a polypeptide having RNA polymerase I subunit activity.

In one embodiment, a polynucleotide comprising SEQ. ID NO: 332 encodes a polypeptide having pentatricopeptide repeat-containing protein activity.

In one embodiment, a polynucleotide comprising SEQ. ID NO: 334 encodes a polypeptide having casein kinase I isoform delta-like activity.

In one embodiment, a polynucleotide comprising SEQ. ID NO: 336 encodes a polypeptide having ribosomal protein activity.

In one embodiment, a polynucleotide comprising SEQ. ID NO: 337 encodes a polypeptide having ATP synthase subunit c activity.

In one embodiment, a polynucleotide comprising SEQ. ID NO: 338 encodes a polypeptide having retrovirus-related Pol polyprotein activity.

In one embodiment, a polynucleotide comprising SEQ. ID NO: 340 encodes a polypeptide having methyltransferase-like protein activity.

In one embodiment, a polynucleotide comprising SEQ. ID NO: 341 encodes a polypeptide having pentatricopeptide repeat-containing protein activity.

In one embodiment, a polynucleotide comprising SEQ. ID NO: 342 encodes a polypeptide having pentatricopeptide repeat-containing protein activity.

In one embodiment, a polynucleotide comprising SEQ. ID NO: 343 encodes a polypeptide having pentatricopeptide repeat-containing protein activity.

In one embodiment, a polynucleotide comprising SEQ. ID NO: 344 encodes a polypeptide having F-Box protein activity.

In one embodiment, a polynucleotide comprising SEQ. ID NO: 346 encodes a polypeptide having polyadenylate-binding protein activity.

In one embodiment, a polynucleotide comprising SEQ. ID NO: 347 encodes a polypeptide having ribosomal protein activity.

In one embodiment, a polynucleotide comprising SEQ. ID NO: 348 encodes a polypeptide having transposase activity.

In one embodiment, a polynucleotide comprising SEQ. ID NO: 349 encodes a polypeptide having disease resistance activity.

In one embodiment, a polynucleotide comprising SEQ. ID NO: 350 encodes a polypeptide having disease resistance activity.

In one embodiment, a polynucleotide comprising SEQ. ID NO: 351 encodes a polypeptide having disease resistance activity.

In one embodiment, a polynucleotide comprising SEQ. ID NO: 352 encodes a polypeptide having ABC transporter C family member activity.

In one embodiment, a polynucleotide comprising SEQ. ID NO: 353 encodes a polypeptide having ABC transporter C family member activity.

In one embodiment, a polynucleotide comprising SEQ. ID NO: 354 encodes a polypeptide having vacuolar protein sorting-associated protein activity.

In one embodiment, a polynucleotide comprising SEQ. ID NO: 355 encodes a polypeptide having omega-amidase activity.

In one embodiment, a polynucleotide comprising SEQ. ID NO: 356 encodes a polypeptide having pentatricopeptide repeat-containing protein activity.

In one embodiment, a polynucleotide comprising SEQ. ID NO: 357 encodes a polypeptide having retrovirus-related Pol polyprotein activity.

In one embodiment, a polynucleotide comprising SEQ. ID NO: 358 encodes a polypeptide having methyltransferase, 4'OMT like activity.

In one embodiment, a polynucleotide comprising SEQ. ID NO: 359 encodes a polypeptide having CYP82X1 activity.

In one embodiment, a polynucleotide comprising SEQ. ID NO: 360 encodes a polypeptide having 3'-hydroxy-N-methyl-(S)-coclaurine 4'-O-methyltransferase activity.

In one embodiment, a polynucleotide comprising SEQ. ID NO: 361 encodes a polypeptide having 5'-3' exoribonuclease 3 activity.

In one embodiment, a polynucleotide comprising SEQ. ID NO: 362 encodes a polypeptide having Splicing factor U2af small subunit A activity.

In one embodiment, a polynucleotide comprising SEQ. ID NO: 363 encodes a polypeptide having pectinesterase activity.

In one embodiment, a polynucleotide comprising SEQ. ID NO: 364 encodes a polypeptide having ribosomal protein activity.

In one embodiment, a polynucleotide comprising SEQ. ID NO: 366 encodes a polypeptide having 1-deoxy-D-xylulose-5-phosphate synthase activity.

In one embodiment, a polynucleotide comprising SEQ. ID NO: 368 encodes a polypeptide having MACPF domain-containing protein activity.

In one embodiment, a polynucleotide comprising SEQ. ID NO: 369 encodes a polypeptide having Short-chain dehydrogenase activity.

In one embodiment, a polynucleotide comprising SEQ. ID NO: 371 encodes a polypeptide having O-methyltransferase activity.

In one embodiment, a polynucleotide comprising SEQ. ID NO: 372 encodes a polypeptide having major latex protein 146 activity.

In one embodiment, a polynucleotide comprising SEQ. ID NO: 373 encodes a polypeptide having B2 Protein activity.

In one embodiment, a polynucleotide comprising SEQ. ID NO: 374 encodes a polypeptide having starch synthase activity.

In one embodiment, a polynucleotide comprising SEQ. ID NO: 375 encodes a polypeptide having protein IQ-DOMAIN 1 activity.

In one embodiment, a polynucleotide comprising SEQ. ID NO: 376 encodes a polypeptide having F-box/kelch-repeat protein activity.

In one embodiment, a polynucleotide comprising SEQ. ID NO: 377 encodes a polypeptide having disease resistance activity.

In one embodiment, a polynucleotide comprising SEQ. ID NO: 378 encodes a polypeptide having RNA polymerase II transcriptional coactivator KELP activity.

In one embodiment, a polynucleotide comprising SEQ. ID NO: 379 encodes a polypeptide having F-box protein SKIP8 activity.

In one embodiment, a polynucleotide comprising SEQ. ID NO: 380 encodes a polypeptide having V-type proton ATPase subunit F activity.

In one embodiment, a polynucleotide comprising SEQ. ID NO: 381 encodes a polypeptide having ubiquitin-protein ligase activity.

In one embodiment, a polynucleotide comprising SEQ. ID NO: 382 encodes a polypeptide having ubiquitin-protein ligase activity.

In one embodiment, a polynucleotide comprising SEQ. ID NO: 383 encodes a polypeptide having methyltetrahydroprotoberberine 14-monooxygenase activity.

In one embodiment, a polynucleotide comprising SEQ. ID NO: 384 encodes a polypeptide having purine permease activity.

In one embodiment, a polynucleotide comprising SEQ. ID NO: 385 encodes a polypeptide having serine/threonine-protein phosphatase activity.

In one embodiment, a polynucleotide comprising SEQ. ID NO: 386 encodes a polypeptide having ribosomal protein activity.

In one embodiment, a polynucleotide comprising SEQ. ID NO: 387 encodes a polypeptide having 3-methyl-2-oxobutanoate hydroxymethyltransferase activity.

In one embodiment, a polynucleotide comprising SEQ. ID NO: 388 encodes a polypeptide having Tobamovirus multiplication protein activity.

In one embodiment, a polynucleotide comprising SEQ. ID NO: 390 encodes a polypeptide having RNA-dependent RNA polymerase activity.

In one embodiment, a polynucleotide comprising SEQ. ID NO: 391 encodes a polypeptide having SART-1 family protein DOT2 activity.

In one embodiment, a polynucleotide comprising SEQ. ID NO: 392 encodes a polypeptide having Graves disease carrier protein activity.

In one embodiment, a polynucleotide comprising SEQ. ID NO: 394 encodes a polypeptide having RNA-dependent RNA polymerase activity.

In one embodiment, a polynucleotide comprising SEQ. ID NO: 395 encodes a polypeptide having leucine-tRNA ligase activity.

In one embodiment, a polynucleotide comprising SEQ. ID NO: 396 encodes a polypeptide having oxidoreductase GLYR1 activity.

In one embodiment, a polynucleotide comprising SEQ. ID NO: 397 encodes a polypeptide having RNA-dependent RNA polymerase 1 activity.

In one embodiment, a polynucleotide comprising SEQ. ID NO: 400 encodes a polypeptide having Phosphate transporter PHO1 activity.

In one embodiment, a polynucleotide comprising SEQ. ID NO: 401 encodes a polypeptide having AC transposase activity.

In one embodiment, a polynucleotide comprising SEQ. ID NO: 402 encodes a polypeptide having cytochrome P450 activity.

In one embodiment, a polynucleotide comprising SEQ. ID NO: 406 encodes a polypeptide having cytochrome P450 activity.

In one embodiment, a polynucleotide comprising SEQ. ID NO: 407 encodes a polypeptide having polyadenylate-binding protein activity.

In one embodiment, a polynucleotide comprising SEQ. ID NO: 408 encodes a polypeptide having disease resistance activity.

In one embodiment, a polynucleotide comprising SEQ. ID NO: 409 encodes a polypeptide having disease resistance activity.

In one embodiment, a polynucleotide comprising SEQ. ID NO: 410 encodes a polypeptide having cyclin activity.

In one embodiment, a polynucleotide comprising SEQ. ID NO: 411 encodes a polypeptide having vacuolar protein sorting-associated protein activity.

In one embodiment, a polynucleotide comprising SEQ. ID NO: 412 encodes a polypeptide having pentatricopeptide repeat-containing protein activity.

In one embodiment, a polynucleotide comprising SEQ. ID NO: 413 encodes a polypeptide having retrovirus-related Pol polyprotein activity.

In one embodiment, a polynucleotide comprising SEQ. ID NO: 414 encodes a polypeptide having pentatricopeptide repeat-containing protein activity.

In one embodiment, a polynucleotide comprising SEQ. ID NO: 415 encodes a polypeptide having Surfeit locus protein activity.

In one embodiment, a polynucleotide comprising SEQ. ID NO: 416 encodes a polypeptide having endoplasmic reticulum-Golgi intermediate compartment protein activity.

In one embodiment, a polynucleotide comprising SEQ. ID NO: 417 encodes a polypeptide having aminoacrylate hydrolase activity.

In one embodiment, a polynucleotide comprising SEQ. ID NO: 418 encodes a polypeptide having ubiquitin-like activity.

In one embodiment, a polynucleotide comprising SEQ. ID NO: 419 encodes a polypeptide having retrovirus-related Pol polyprotein activity.

In one embodiment, a polynucleotide comprising SEQ. ID NO: 420 encodes a polypeptide having protein trichome birefringence-like activity.

In one embodiment, a polynucleotide comprising SEQ. ID NO: 421 encodes a polypeptide having cytochrome b6-f complex iron-sulfur subunit activity.

In one embodiment, a polynucleotide comprising SEQ. ID NO: 422 encodes a polypeptide having zinc finger MYM-type protein activity.

In one embodiment, a polynucleotide comprising SEQ. ID NO: 423 encodes a polypeptide having cysteine-rich repeat secretory protein activity.

In one embodiment, a polynucleotide comprising SEQ. ID NO: 424 encodes a polypeptide having retrovirus-related Pol polyprotein activity.

In one embodiment, a polynucleotide comprising SEQ. ID NO: 426 encodes a polypeptide having retrovirus-related Pol polyprotein activity.

In one embodiment, a polynucleotide comprising SEQ. ID NO: 427 encodes a polypeptide having Retrovirus-related Pol polyprotein activity.

In one embodiment, a polynucleotide comprising SEQ. ID NO: 429 encodes a polypeptide having homeobox protein knotted-1-like activity.

In one embodiment, a polynucleotide comprising SEQ. ID NO: 430 encodes a polypeptide having aspartic proteinase nepenthesin activity.

In one embodiment, a polynucleotide comprising SEQ. ID NO: 431 encodes a polypeptide having ATP synthase mitochondrial F1 complex assembly factor activity.

In one embodiment, a polynucleotide comprising SEQ. ID NO: 432 encodes a polypeptide having ribonuclease activity.

In one embodiment, a polynucleotide comprising SEQ. ID NO: 433 encodes a polypeptide having fer-like iron deficiency-induced transcription factor activity.

In one embodiment, a polynucleotide comprising SEQ. ID NO: 434 encodes a polypeptide having superoxide dismutase activity.

In one embodiment, a polynucleotide comprising SEQ. ID NO: 435 encodes a polypeptide having leucine zipper activity.

In one embodiment, a polynucleotide comprising SEQ. ID NO: 436 encodes a polypeptide having AC transposase activity.

In one embodiment, a polynucleotide comprising SEQ. ID NO: 437 encodes a polypeptide having serine/threonine-protein phosphatase activity.

In one embodiment, a polynucleotide comprising SEQ. ID NO: 438 encodes a polypeptide having mechanosensitive ion channel protein activity.

In one embodiment, a polynucleotide comprising SEQ. ID NO: 439 encodes a polypeptide having serine/threonine-protein phosphatase activity.

In one embodiment, a polynucleotide comprising SEQ. ID NO: 440 encodes a polypeptide having retrovirus-related Pol polyprotein activity.

In one embodiment, a polynucleotide comprising SEQ. ID NO: 441 encodes a polypeptide having mechanosensitive ion channel protein activity.

In one embodiment, a polynucleotide comprising SEQ. ID NO: 442 encodes a polypeptide having norcoclaurine 6-O-methyltransferase activity.

In one embodiment, a polynucleotide comprising SEQ. ID NO: 443 encodes a polypeptide having serine hydroxymethyltransferase activity.

In one embodiment, a polynucleotide comprising SEQ. ID NO: 444 encodes a polypeptide having 3'-hydroxy-N-methyl-(S)-coclaurine 4'-O-methyltransferase activity.

In one embodiment, a polynucleotide comprising SEQ. ID NO: 445 encodes a polypeptide having 12-oxophytodienoate reductase activity.

In one embodiment, a polynucleotide comprising SEQ. ID NO: 446 encodes a polypeptide having methylcoclaurine 3'-hydroxylase isozyme activity.

In one embodiment, a polynucleotide comprising SEQ. ID NO: 447 encodes a polypeptide having cytochrome P450 activity.

In one embodiment, a polynucleotide comprising SEQ. ID NO: 448 encodes a polypeptide having cytochrome P450 activity.

In one embodiment, a polynucleotide comprising SEQ. ID NO: 449 encodes a polypeptide having O-methyltransferase activity.

In one embodiment, a polynucleotide comprising SEQ. ID NO: 450 encodes a polypeptide having Glyceraldehyde-3-phosphate dehydrogenase activity.

In one embodiment, a polynucleotide comprising SEQ. ID NO: 451 encodes a polypeptide having endoribonuclease Dicer activity.

In one embodiment, a polynucleotide comprising SEQ. ID NO: 452 encodes a polypeptide having developmentally-regulated G-protein activity.

In one embodiment, a polynucleotide comprising SEQ. ID NO: 453 encodes a polypeptide having telomere repeat-binding protein activity.

In one embodiment, a polynucleotide comprising SEQ. ID NO: 454 encodes a polypeptide having serine/threonine-protein kinase activity.

In one embodiment, a polynucleotide comprising SEQ. ID NO: 455 encodes a polypeptide having retrovirus-related Pol polyprotein activity.

In one embodiment, a polynucleotide comprising SEQ. ID NO: 456 encodes a polypeptide having rho GTPase activity.

In one embodiment, a polynucleotide comprising SEQ. ID NO: 457 encodes a polypeptide having chaperone protein DnaJ activity.

In one embodiment, a polynucleotide comprising SEQ. ID NO: 458 encodes a polypeptide having methionine t-RNA ligase activity.

In one embodiment, a polynucleotide comprising SEQ. ID NO: 459 encodes a polypeptide having cyclin activity.

In one embodiment, a polynucleotide comprising SEQ. ID NO: 460 encodes a polypeptide having Rac-like GTP-binding protein activity.

In one embodiment, a polynucleotide comprising SEQ. ID NO: 461 encodes a polypeptide having AC transposase activity.

In one embodiment, a polynucleotide comprising SEQ. ID NO: 463 encodes a polypeptide having ribonuclease H activity.

In one embodiment, a polynucleotide comprising SEQ. ID NO: 465 encodes a polypeptide having retrovirus-related Pol polyprotein activity.

In one embodiment, a polynucleotide comprising SEQ. ID NO: 466 encodes a polypeptide having Ty3-G Gag-Pol polyprotein activity.

In one embodiment, a polynucleotide comprising SEQ. ID NO: 467 encodes a polypeptide having purple acid phosphatase activity.

In one embodiment, a polynucleotide comprising SEQ. ID NO: 469 encodes a polypeptide having retrovirus-related Pol polyprotein activity.

In one embodiment, a polynucleotide comprising SEQ. ID NO: 470 encodes a polypeptide having MORC family CW-type zinc finger protein activity.

In one embodiment, a polynucleotide comprising SEQ. ID NO: 471 encodes a polypeptide having Protein trichome birefringence activity.

In one embodiment, a polynucleotide comprising SEQ. ID NO: 472 encodes a polypeptide having Inter-alpha-trypsin inhibitor heavy chain H2 activity.

In one embodiment, a polynucleotide comprising SEQ. ID NO: 473 encodes a polypeptide having cullin-associated NEDD8-dissociated protein activity.

In one embodiment, a polynucleotide comprising SEQ. ID NO: 474 encodes a polypeptide having chaperone protein DnaJ activity.

In one embodiment, a polynucleotide comprising SEQ. ID NO: 475 encodes a polypeptide having B3 domain-containing protein activity.

In one embodiment, a polynucleotide comprising SEQ. ID NO: 476 encodes a polypeptide having AC transposase activity.

In one embodiment, a polynucleotide comprising SEQ. ID NO: 477 encodes a polypeptide having purine permease activity.

In one embodiment, a polynucleotide comprising SEQ. ID NO: 478 encodes a polypeptide having purine permease activity.

In one embodiment, a polynucleotide comprising SEQ. ID NO: 479 encodes a polypeptide having ribonuclease activity.

In one embodiment, a polynucleotide comprising SEQ. ID NO: 480 encodes a polypeptide having polyubiquitin activity.

In one embodiment, a polynucleotide comprising SEQ. ID NO: 481 encodes a polypeptide having polyubiquitin activity.

In one embodiment, a polynucleotide comprising SEQ. ID NO: 482 encodes a polypeptide having metallophosphoesterase activity.

In one embodiment, a polynucleotide comprising SEQ. ID NO: 483 encodes a polypeptide having retrovirus-related Pol polyprotei activity.

In one embodiment, a polynucleotide comprising SEQ. ID NO: 484 encodes a polypeptide having oxoglutarate/Fe(II)-dependent dioxygenase activity.

In one embodiment, a polynucleotide comprising SEQ. ID NO: 485 encodes a polypeptide having gibberellin 2-beta-dioxygenase activity.

In one embodiment, a polynucleotide comprising SEQ. ID NO: 486 encodes a polypeptide having oxoglutarate/Fe(II)-dependent dioxygenase activity.

In one embodiment, a polynucleotide comprising SEQ. ID NO: 487 encodes a polypeptide having ribosomal protein activity.

In one embodiment, a polynucleotide comprising SEQ. ID NO: 488 encodes a polypeptide having AC transposase activity.

In one embodiment, a polynucleotide comprising SEQ. ID NO: 489 encodes a polypeptide having zinc finger BED domain-containing protein RICESLEEPER activity.

In one embodiment, a polynucleotide comprising SEQ. ID NO: 490 encodes a polypeptide having cytochrome b6-f complex iron-sulfur subunit activity.

In one embodiment, a polynucleotide comprising SEQ. ID NO: 491 encodes a polypeptide having retrovirus-related Pol polyprotein activity.

In one embodiment, a polynucleotide comprising SEQ. ID NO: 492 encodes a polypeptide having phloem protein-like activity.

In one embodiment, a polynucleotide comprising SEQ. ID NO: 493 encodes a polypeptide having beta glucosidase activity.

In one embodiment, a polynucleotide comprising SEQ. ID NO: 494 encodes a polypeptide having transposon Ty3-G Gag-Pol polyprotein activity.

In one embodiment, a polynucleotide comprising SEQ. ID NO: 496 encodes a polypeptide having retrotransposable element ORF2 protein activity.

In one embodiment, a polynucleotide comprising SEQ. ID NO: 497 encodes a polypeptide having retrotransposable element SLACS activity.

In one embodiment, a polynucleotide comprising SEQ. ID NO: 498 encodes a polypeptide having magnesium-transporting ATPase activity.

In one embodiment, a polynucleotide comprising SEQ. ID NO: 499 encodes a polypeptide having glucan 1,3-beta-glucosidase activity.

In one embodiment, a polynucleotide comprising SEQ. ID NO: 500 encodes a polypeptide having indole-3-acetic acid-amido synthetase activity.

In one embodiment, a polynucleotide comprising SEQ. ID NO: 501 encodes a polypeptide having transcription factor activity.

In one embodiment, a polynucleotide comprising SEQ. ID NO: 502 encodes a polypeptide having reverse transcriptase activity.

In one embodiment, a polynucleotide comprising SEQ. ID NO: 503 encodes a polypeptide having indole-3-acetic acid-amido synthetase activity.

In another aspect, the present disclosure provides, in at least one embodiment, a a polynucleotide comprising at least one nucleic acid sequence selected from the nucleic acid sequences consisting of
  (a) SEQ. ID NO: 384; SEQ. ID NO: 902 and SEQ. ID NO: 903;
  (b) a nucleic acid sequence of which at least one is substantially identical to any one of the nucleic acid sequences of (a);
  (c) a nucleic acid sequence of which at least one is substantially identical to any one of the nucleic acid sequences of (a) but for the degeneration of the genetic code;
  (d) a nucleic acid sequence of which at least one is complementary to any one of the nucleic acid sequences of (a);
  (e) a nucleic acid sequence encoding a polypeptide having the amino acid sequence set forth in SEQ. ID NO: 779 or SEQ. ID NO: 901;
  (f) a nucleic acid sequence encoding a functional variant of a polypeptide having the amino acid sequence set forth in SEQ. ID NO: 770 or SEQ. ID NO: 901; and
  (g) a nucleic acid sequence that hybridizes under stringent conditions to any one of the nucleic acid sequences set forth in (a), (b), (c), (d), (e) or (f);
expressed in a heterologous host cell to facilitate transport of an alkaloid compound across a cellular membrane. In some embodiments, the alkaloid is exported from the cell. In some embodiments, the alkaloid is exported from the cell and secreted in a cell growth medium.

In some embodiments, the alkaloid compound is selected from (S)-norcoclaurine, (S)-coclaurine, (S)—N-methylcoclaurine, (S)-3'-hydroxy-N-methylcoclaurine, (S)-reticuline, (R)-reticuline, salutaridine, salutaridinol, thebaine, oripavine, morphinone, codeinone, codeine and morphine.

In some embodiments, the heterologous host cell is a microbial host cell.

In some embodiments, the heterologous host cell is a *Saccharomyces cerevisiae* host cell or a *Yarrowia lipolytica* host cell.

In one embodiment, a first alkaloid can be brought in contact with a polypeptide of the present disclosure under reaction conditions permitting chemical conversion of the first alkaloid under in vitro reaction conditions to form a second alkaloid. Under such in vitro reaction conditions, in certain embodiments, the initial reaction constituents can be provided in more or less pure form and can be mixed under conditions that permit the chemical reaction to substantially proceed. Thus a mixture comprising one of the polypeptides and a first alkaloid may be provided and mixed under in vitro reaction conditions that permit the conversion of the first alkaloid to form a second alkaloid.

In another embodiment, a first alkaloid can be brought in contact with a polypeptide of the present disclosure under reaction conditions permitting a chemical conversion of a first alkaloid under in vivo reaction conditions. Under such in vivo reaction conditions living cells are modified in such a manner that they produce the second alkaloid. Accordingly, provided herein further, is a method for preparing an alkaloid, the method comprising:

(A) providing a chimeric polynucleotide comprising as operably linked components:
  (i) a first polynucleotide comprising a nucleic acid sequence selected from the nucleic acid sequences consisting of
    (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 and SEQ. ID. NO: 766;
    (b) a nucleic acid sequence that is substantially identical to any one of the nucleic acid sequences of (a);
    (c) a nucleic acid sequence that is substantially identical to any one of the nucleic acid sequences of (a) but for the degeneration of the genetic code;
    (d) a nucleic acid sequence that is complementary to any one of the nucleic acid sequences of (a);
    (e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID. NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;
    (f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and
    (g) a nucleic acid sequence that hybridizes under stringent conditions to any one of the nucleic acid sequences set forth in (a), (b), (c), (d), (e) or (f); and
  (ii) a second polynucleotide capable of controlling expression in a host cell;
(B) introducing the chimeric polynucleotide into a host cell that endogenously produces or is exogenously supplied with a first alkaloid;
(C) growing the host cell to produce a polypeptide expressed by the first polynucleotide and to further produce a second alkaloid by converting the first alkaloid into the second alkaloid in a reaction mediated by the polypeptide; and
(D) recovering the second alkaloid from the cell.

In some embodiments, a first and second polynucleotide are selected.

In some embodiments, a first polynucleotide comprising either SEQ. ID NO: 6 or SEQ. ID NO: 372 is selected and a second polynucleotide comprising SEQ. ID NO: 384, SEQ. ID NO: 902 or SEQ. ID NO: 903 is selected.

In another aspect, the polynucleotides of the present disclosure may be used to produce a cell that exhibits modulated levels of expression of a polypeptide of the present disclosure. In some embodiments, such a cell is a plant cell naturally expressing the polynucleotides of the present disclosure.

Accordingly, the present disclosure further provides, in a further embodiment, a method for modulating expression of polynucleotide in a cell naturally expressing such polynucleotide, the method comprising:
  (a) providing a cell naturally expressing a polynucleotide;
  (b) mutagenizing the cell;
  (c) growing the cell to obtain a plurality of cells; and
  (d) determining if the plurality of cells comprises a cell comprising modulated levels of a polypeptide encoded by the polynucleotide; and
wherein, the polynucleotide comprises a nucleic acid sequence selected from the nucleic acid sequences consisting of
  (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID NO: 50, SEQ. ID NO: 51, SEQ. ID NO: 52, SEQ. ID NO: 53, SEQ. ID.
NO: 54, SEQ. ID NO: 55, SEQ. ID NO: 56, SEQ. ID
NO: 57, SEQ. ID. NO: 58, SEQ. ID NO: 59, SEQ. ID
NO: 60, SEQ. ID. NO: 75, SEQ. ID NO: 76, SEQ. ID
NO: 77, SEQ. ID NO: 78, SEQ. ID. NO: 79, SEQ. ID
NO: 80, SEQ. ID NO: 81, SEQ. ID NO: 82, SEQ. ID
NO: 83, SEQ. ID NO: 84, SEQ. ID. NO: 85, SEQ. ID
NO: 86, SEQ. ID NO: 87, SEQ. ID NO: 88, SEQ. ID.
NO: 89, SEQ. ID NO: 90, SEQ. ID NO: 91, SEQ. ID
NO: 92, SEQ. ID NO: 93, SEQ. ID NO: 113 to SEQ.
ID NO: 505 and SEQ. ID. NO: 766;
(b) a nucleic acid sequence that is substantially identical to any one of the nucleic acid sequences of (a);
(c) a nucleic acid sequence that is substantially identical to any one of the nucleic acid sequences of (a) but for the degeneration of the genetic code;
(d) a nucleic acid sequence that is complementary to any one of the nucleic acid sequences of (a);
(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID. NO: 44, SEQ. ID NO: 45, SEQ. ID. NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;
(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID. NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;
(g) a nucleic acid sequence that hybridizes under stringent conditions to any one of the nucleic acid sequences set forth in (a), (b), (c), (d), (e) or (f).

In some embodiments, the method further comprises a step (e) as follows:
(e) selecting a cell comprising modulated levels of the polypeptide and growing such cell to obtain a plurality of cells.

In preferred embodiments, plant seed cells are used to perform the mutagenesis. Mutagenic agents that may be used are chemical agents, including without limitation, base analogues, deaminating agents, alkylating agents, intercalating agents, transposons, bromine, sodium azide, ethyl methanesulfonate (EMS) as well as physical agents, including, without limitation, radiation, such as ionizing radiation and UV radiation.

Thus the present disclosure further provides, in a further embodiment, a method for producing a seed setting plant comprising modulated expression of a polynucleotide in a cell naturally expressing the polynucleotide, the method comprising:
(a) providing a seed setting plant naturally expressing a polynucleotide;
(b) mutagenizing seed of the plant to obtain mutagenized seed;
(c) growing the mutagenized seed into the next generation mutagenized plants capable of setting the next generation seed; and
(d) obtaining the next generation seed, or another portion of the mutagenized plants, and analyzing if the next generation plants or next generation seed exhibits modulated polynucleotide expression; and
wherein the polynucleotide comprises a nucleic acid sequence selected from the nucleic acid sequences consisting of
(a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 and SEQ. ID. NO: 766;
(b) a nucleic acid sequence that is substantially identical to any one of the nucleic acid sequences of (a);
(c) a nucleic acid sequence that is substantially identical to any one of the nucleic acid sequences of (a) but for the degeneration of the genetic code;
(d) a nucleic acid sequence that is complementary to any one of the nucleic acid sequences of (a);
(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ.

ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID. NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and (g) a nucleic acid sequence that hybridizes under stringent conditions to any one of the nucleic acid sequences set forth in (a), (b), (c), (d), (e) or (f).

In preferred embodiments, a plurality of generations of plants or seed may be obtained, and portions of plants or seed in any or all of such generations may be analyzed. Analysis is typically performed by comparing expression levels (e.g. RNA levels or protein levels) in non-mutagenized (wild type) plants or seed with expression in mutagenized plants or seed. In further preferred embodiments, the analysis in step (d) may be performed by analyzing heteroduplex formation between wildtype DNA and mutated DNA. Thus in preferred embodiments, the analysing in step (d) comprises i. extracting DNA from mutated plants;
ii. amplifying a portion of the DNA comprising a nucleic acid sequence encoding codeine isomerase or codeinone reductase to obtain amplified mutated DNA;
iii. extracting DNA from wild type plants;
iv. mixing the DNA from wild type plants with the amplified mutated DNA and form a heteroduplexed polynucleotide;
v. incubating the heteroduplexed polynucleotide with a single stranded restriction nuclease capable of restricting at a region of the heteroduplexed polynucleotide that is mismatched; and
vi. determining the site of mismatch in the heteroduplex polynucleotide.

In further aspects, the polynucleotides of the present disclosure may be used to produce a cell that exhibits modulated levels of expression of a polynucleotide of the present disclosure by gene silencing the polynucleotide. Thus the present disclosure, in a further embodiment, includes a method of reducing the expression of a polynucleotide in a cell, comprising:

(a) providing a cell expressing a polynucleotide; and
(b) silencing expression of the polynucleotide in the cell; and wherein the polynucleotide comprises a nucleic acid sequence selected from the nucleic acid sequences consisting of (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 and SEQ. ID. NO: 766;

(b) a nucleic acid sequence that is substantially identical to any one of the nucleic acid sequences of (a);
(c) a nucleic acid sequence that is substantially identical to any one of the nucleic acid sequences of (a) but for the degeneration of the genetic code;
(d) a nucleic acid sequence that is complementary to any one of the nucleic acid sequences of (a);
(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, or SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and (g) a nucleic acid sequence that hybridizes under stringent conditions to any one of the nucleic acid sequences set forth in (a), (b), (c), (d), (e) or (f).

In preferred embodiments, the cell is a plant cell.

In some embodiments, the plant belongs to the plant family of Papaveraceae.

In some embodiments, the plant belongs to the plant species *Papaver somniferum, Papaver bracteatum, Papaver nudicale, Papaver orientale* or *Papaver rhoeas*. A preferred methodology to silence the polynucleotide that is used is virus induced gene silencing (known to the art as VIGS). In general, in plants infected with unmodified viruses, the viral genome is targeted. However, when viral vectors have been modified to carry inserts derived from host genes (e.g. portions of sequences encoding codeine isomerase or codeinone reductase), the process is additionally targeted against the corresponding mRNAs. Thus the present disclosure further includes a method of producing a plant expressing reduced levels of the polynucleotide, the method comprising (h) providing a plant expressing a polynucleotide; and
(i) reducing expression of the polynucleotide in the plant using virus induced gene silencing; and wherein polynucleotide comprising a nucleic acid sequence selected from the nucleic acid sequences consisting of (a) SEQ. ID NO: 1, SEQ. ID NO: 2, SEQ. ID NO: 3, SEQ. ID. NO: 4, SEQ. ID NO: 5, SEQ. ID NO: 6, SEQ. ID NO: 7, SEQ. ID. NO: 8, SEQ. ID NO: 9, SEQ. ID NO: 10, SEQ. ID NO: 11, SEQ. ID. NO: 12, SEQ. ID NO: 13, SEQ. ID NO: 14, SEQ. ID NO: 15, SEQ. ID. NO: 16, SEQ. ID NO: 17, SEQ. ID NO: 18, SEQ. ID NO: 19, SEQ. ID. NO: 20, SEQ. ID NO: 21, SEQ. ID NO: 22, and SEQ. ID NO: 23, SEQ. ID NO: 47, SEQ. ID NO: 48, SEQ. ID NO: 49, SEQ. ID. NO: 50, SEQ. ID NO: 51, SEQ. ID NO: 52, SEQ. ID NO: 53, SEQ. ID. NO: 54, SEQ. ID NO: 55, SEQ. ID NO: 56, SEQ. ID NO: 57, SEQ. ID. NO: 58, SEQ. ID NO: 59, SEQ. ID NO: 60, SEQ. ID. NO: 75, SEQ. ID NO: 76, SEQ. ID NO: 77, SEQ. ID NO: 78, SEQ. ID. NO: 79, SEQ. ID NO: 80, SEQ. ID NO: 81, SEQ. ID NO: 82, SEQ. ID NO: 83, SEQ. ID NO: 84, SEQ. ID. NO: 85, SEQ. ID NO: 86, SEQ. ID NO: 87, SEQ. ID NO: 88, SEQ. ID. NO: 89, SEQ. ID NO: 90, SEQ. ID NO: 91, SEQ. ID NO: 92, SEQ. ID NO: 93, SEQ. ID NO: 113 to SEQ. ID NO: 505 and SEQ. ID. NO: 766;

(b) a nucleic acid sequence that is substantially identical to any one of the nucleic acid sequences of (a);

(c) a nucleic acid sequence that is substantially identical to any one of the nucleic acid sequences of (a) but for the degeneration of the genetic code;

(d) a nucleic acid sequence that is complementary to any one of the nucleic acid sequences of (a);

(e) a nucleic acid sequence encoding a polypeptide having any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901;

(f) a nucleic acid sequence that encodes a functional variant of any one of the amino acid sequences set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and (g) a nucleic acid sequence that hybridizes under stringent conditions to any one of the nucleic acid sequences set forth in (a), (b), (c), (d), (e) or (f).

The hereinbefore mentioned methods to modulate expression levels of the polynucleotide may result in modulations in the levels of plant alkaloids, including without limitation in the levels of morphine, thebaine and reticuline. Thus the present disclosure includes the use of the methodologies to modify the levels of plant alkaloids in a plant naturally capable of producing plant alkaloids.

Modulation of expression may be achieved in a variety of ways. In one embodiment, Antisense or RNA interference approaches may be used to down-regulate expression of the polynucleotides of the present disclosure, e.g., as a further mechanism for modulating cellular phenotype. That is, antisense sequences of the polynucleotides of the present disclosure, or subsequences thereof, may be used to block expression of naturally occurring homologous polynucleotide sequences. A variety of sense and antisense technologies, e.g., as set forth in Lichtenstein and Nellen (Antisense Technology: A Practical Approach IRL Press at Oxford University, Oxford, England, 1997), can be used.

In certain embodiments, sense or antisense polynucleotide are introduced into a cell, where they are transcribed. Such polynucleotides may include both simple oligonucleotide sequences and catalytic sequences such as ribozymes.

In certain embodiments, a reduction or elimination of expression (i.e., a "knock-out" or "knockdown") thebaine synthesis polypeptide in a transgenic cell or plant is produced by introduction of a construct which expresses an antisense of a thebaine synthesis polypeptide coding strand or fragment thereof. For antisense suppression, the thebaine synthesis polypeptide cDNA or fragment thereof is arranged in reverse orientation (with respect to the coding sequence) relative to the promoter sequence in the expression vector. In certain embodiments, the introduced sequence need not correspond to the full length cDNA or gene, and need not be identical to the cDNA or gene found in the cell or plant to be transformed.

In certain embodiments, the antisense sequence need only be capable of hybridizing to the target gene or RNA of interest. Thus, where the introduced polynucleotide sequence is of shorter length, a higher degree of homology to the endogenous transcription factor sequence will be needed for effective antisense suppression. While antisense sequences of various lengths can be utilized, in some embodiments, the introduced antisense polynucleotide sequence in the vector is at least 10, 20, 30, 40, 50, 100 or more nucleotides in length in certain embodiments. Transcription of an antisense construct as described results in the production of RNA molecules that comprise a sequence that is the reverse complement of the mRNA molecules transcribed from the endogenous gene to be repressed.

In certain embodiments, a reduction or elimination of expression (i.e., a "knock-out" or "knockdown") of thebaine synthesis polypeptide in a transgenic cell or plant is accomplished by introduction of a construct that expresses siRNA that targets thebaine synthesis polypeptide. In certain embodiments, siRNAs are short (20 to 24-bp) double-stranded RNA (dsRNA) with phosphorylated 5' ends and hydroxylated 3' ends with two overhanging nucleotides.

Antisense and RNAi treatments represent one way of altering thebaine synthesis polypeptide activity in accordance with the invention. In particular, constructs comprising a thebaine synthesis polypeptide coding sequence, including fragments thereof, in antisense orientation, or combinations of sense and antisense orientation, may be used to decrease or effectively eliminate the expression of thebaine synthesis polypeptide in a cell or plant and obtain an improvement in shelf life as is described herein. Accordingly, this may be used to "knock-out" the thebaine synthesis polypeptide or homologous sequences thereof.

Techniques for RNAi are well known in the art and are described in, for example, Lavorgna et al., 2004, Trends in Biochem Sci 29 (2) 88-94 and Downward, 2004, BMJ 328 (7450) 1245-1248. The technique is based on the fact that double stranded RNA is capable of directing the degradation of messenger RNA with sequence complementary to one or the other strand. Therefore, by expression of a particular coding sequence in sense and antisense orientation, either as a fragment or longer portion of the corresponding coding sequence, the expression of that coding sequence can be down-regulated.

In one embodiment, a reduction or elimination of expression (i.e., a "knock-out") of a thebaine synthesis polypeptide in a transgenic plant can be obtained by insertion mutagenesis using the T-DNA of Agrobacterium tumefaciens or a selection marker cassette or any other non-sense DNA fragments. After generating the insertion mutants, the mutants can be screened to identify those containing the insertion in the thebaine synthesis polypeptide gene. Plants containing one or more transgene insertion events at the desired gene can be crossed to generate homozygous plant for the mutation, as described in Koncz et al., (Methods in Arabidopsis Research; World Scientific, 1992).

Suppression of gene expression may also be achieved using a ribozyme. Ribozymes are RNA molecules that possess highly specific endoribonuclease activity. The production and use of ribozymes are disclosed in U.S. Pat. Nos. 4,987,071 and 5,543,508, which are incorporated by reference in their entirety. Synthetic ribozyme sequences including antisense RNAs can be used to confer RNA cleaving activity on the antisense RNA, such that endogenous mRNA molecules that hybridize to the antisense RNA are cleaved, which in turn leads to an enhanced antisense inhibition of endogenous gene expression.

A cell or plant trait may also be modified by using the Cre-lox system (for example, as described in U.S. Pat. No. 5,658,772). A cellular or plant genome can be modified to include first and second lox sites that are then contacted with a Cre recombinase. If the lox sites are in the same orientation, the intervening DNA sequence between the two sites is excised. If the lox sites are in the opposite orientation, the intervening sequence is inverted. In addition, silencing approach using short hairpin RNA (shRNA) system, and complementary mature CRISPR RNA (crRNA) by CRISPR/Cas system, and virus inducing gene silencing (VIGS) system may also be used to make down regulated or knockout of synthase mutants. Dominant negative approaches may also be used to make down regulated or knockout of THCA synthase mutants.

The RNA-guided endonuclease can be derived from a clustered regularly interspersed short palindromic repeats (CRISPR)/CRISPR-associated (Cas) system. The CRISPR/Cas system can be a type I, a type II, or a type III system. Non-limiting examples of suitable CRISPR/Cas proteins include Cas3, Cas4, Cas5, Cas5e (or CasD), Cash, Cas6e, Cas6f, Cas7, Cas8a1, Cas8a2, Cas8b, Cas8c, Cas9, Cas1O, Cas1Od, CasF, CasG, CasH, Csy1, Csy2, Csy3, Cse1 (or CasA), Cse2 (or CasB), Cse3 (or CasE), Cse4 (or CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csxl7, Csxl4, CsxlO, Csxl6, CsaX, Csx3, Cszl, Csxl5, Csf1, Csf2, Csf3, Csf4, and Cul966.

In general, CRISPR/Cas proteins comprise at least one RNA recognition or RNA binding domain. RNA recognition or RNA binding domains interact with guide RNAs. CRISPR/Cas proteins can also comprise nuclease domains (i.e., DNase or RNase domains), DNA binding domains, helicase domains, RNAse domains, protein-protein interaction domains, dimerization domains, as well as other domains.

The CRISPR/Cas-like protein can be a wild type CRISPR/Cas protein, a modified CRISPR/Cas protein, or a fragment of a wild type or modified CRISPR/Cas protein. The CRISPR/Cas-like protein can be modified to increase nucleic acid binding affinity and/or specificity, alter an enzyme activity, or change another property of the protein. For example, nuclease (i.e., DNase, RNase) domains of the CRISPR/Cas-like protein can be modified, deleted, or inactivated. Alternatively, the CRISPR/Cas-like protein can be truncated to remove domains that are not essential for the function of the fusion protein. The CRISPR/Cas-like protein can also be truncated or modified to optimize the activity of the effector domain of the fusion protein.

In some embodiments, the plant belongs to the plant family of Papaveraceae.

In some embodiments, the plant belongs to the plant species *Papaver somniferum, Papaver bracteatum, Papaver nudicale, Papaver orientale* or *Papaver rhoeas*.

In another aspect of the present disclosure, the polynucleotides of the present disclosure may be used to examine the presence of the polynucleotide in a cell, or a cell extract, such as a polynucleotide containing extract. Accordingly, in some embodiments, the polynucleotides of the present disclosure may be labeled and used as a probe to examine the presence of the polynucleotide in a cell, or a cell extract.

In another aspect of the present disclosure, the polynucleotides of the present disclosure may be used to genotype plants.

In some embodiments, the plant belongs to the plant family of Papaveraceae.

In some embodiments, the plant belongs to the species *Papaver somniferum, Papaver bracteatum, Papaver nudicale, Papaver orientale* or *Papaver rhoeas*.

In general, genotyping provides a means of distinguishing homologs of a chromosome pair and can be used to identify segregants in subsequent generations of a plant population. Molecular marker methodologies can be used for phylogenetic studies, characterizing genetic relationships among plant varieties, identifying crosses or somatic hybrids, localizing chromosomal segments affecting monogenic traits, map based cloning, and the study of quantitative inheritance. See, e.g., Plant Molecular Biology: A Laboratory Manual, Chapter 7, Clark, Ed., Springer-Verlag, Berlin (1997). For molecular marker methodologies, see generally, The DNA Revolution by Andrew H. Paterson 1996 (Chapter 2) in: Genome Mapping in Plants (ed. Andrew H. Paterson) by Academic Press/R. G. Landis Company, Austin, Tex., pp. 7-21. The particular method of genotyping in accordance with the present disclosure may involve the employment of any molecular marker analytic technique including, but not limited to, restriction fragment length polymorphisms (RFLPs). RFLPs reflect allelic differences between DNA restriction fragments caused by nucleic acid sequence variability. As is known to those of skill in the art, RFLPs are typically detected by extraction of plant genomic DNA and digestion of the genomic DNA with one or more restriction enzymes. Typically, the resulting fragments are separated according to size and hybridized with a nucleic acid probe. Restriction fragments from homologous chromosomes are revealed. Differences in fragment size among alleles represent an RFLP. Thus, the present disclosure further provides a means to follow segregation of a portion or genomic DNA encoding a polynucleotide of the present disclosure, as well as chromosomal nucleic acid sequences genetically linked to these polynucleotides using such techniques as RFLP analysis. Linked chromosomal nucleic sequences are within 50 centiMorgans (cM), often within 40 or 30 cM, preferably within 20 or 10 cM, more preferably within 5, 3, 2, or 1 cM of a genomic nucleic acid sequence encoding a polypeptide of the present disclosure. Thus, in accordance with the present disclosure the polynucleotides of the present disclosure may be used as markers to evaluate in a plant population the segregation of polynucleotides genetically linked thereto. In some embodiments, the plant population comprises or consists of plants belonging to the plant families Papaveraceae. In other embodiments, the plant population comprises or consists of plants belonging to the plants species *Papaver somniferum, Papaver bracteatum Papaver nudicale, Papaver orientale* or *Papaver rhoeas*.

In accordance with the present disclosure, the polynucleotide probes employed for molecular marker mapping of plant nuclear genomes selectively hybridize, under selective hybridization conditions, to a genomic sequence encoding a polypeptide of the present disclosure, including, in specific embodiments, polypeptides comprising an amino acid sequence selected from SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and in other embodiments, a functional variant of a polypeptide having an amino acid sequence set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901.

Typically, these probes are cDNA probes. Typically these probes are at least 15 bases in length, more preferably at least 20, 25, 30, 35, 40, or 50 bases in length. Generally, however, the probes are less than about 1 kilobase in length. Preferably, the probes are single copy probes that hybridize to a unique locus in a haploid plant chromosome complement. Some exemplary restriction enzymes employed in RFLP mapping are EcoRI, EcoRv, and SstI. As used herein the term "restriction enzyme" includes reference to a composition that recognizes and, alone or in conjunction with another composition, cleaves a polynucleotide at a specific nucleic acid sequence.

Other methods of differentiating polymorphic (allelic) variants of the nucleic acid sequences of the present disclosure can be used by utilizing molecular marker techniques well known to those of skill in the art, including, without limitation: 1) single stranded conformation analysis (SSCP);

2) denaturing gradient gel electrophoresis (DGGE); 3) RNase protection assays; 4) allele-specific oligonucleotides (ASOs); 5) the use of proteins which recognize nucleotide mismatches, such as the *E. coli* mutS protein; and 6) allele-specific PCR. Other approaches based on the detection of mismatches between the two complementary DNA strands include, without limitation, clamped denaturing gel electrophoresis (CDGE); heteroduplex analysis (HA), and chemical mismatch cleavage (CMC).

Thus, the present disclosure further provides a method of genotyping comprising the steps of contacting, under stringent hybridization conditions, a sample suspected of comprising a nucleic acid encoding a polypeptide of the present disclosure, including, in specific embodiments, polypeptides comprising an amino acid sequence selected from SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901; and in other embodiments, a functional variant of a polypeptide having an amino acid sequence set forth in SEQ. ID NO: 24, SEQ. ID NO: 25, SEQ. ID NO: 26, SEQ. ID. NO: 27, SEQ. ID NO: 28, SEQ. ID NO: 29, SEQ. ID NO: 30, SEQ. ID. NO: 31, SEQ. ID NO: 32, SEQ. ID NO: 33, SEQ. ID NO: 34, SEQ. ID. NO: 35, SEQ. ID NO: 36, SEQ. ID NO: 37, SEQ. ID NO: 38, SEQ. ID. NO: 39, SEQ. ID NO: 40, SEQ. ID NO: 41, SEQ. ID NO: 42, SEQ. ID. NO: 43, SEQ. ID NO: 44, SEQ. ID NO: 45, SEQ. ID NO: 46, SEQ. ID NO: 61, SEQ. ID NO: 62, SEQ. ID NO: 63, SEQ. ID NO: 64, SEQ. ID. NO: 65, SEQ. ID NO: 66, SEQ. ID NO: 67, SEQ. ID NO: 68, SEQ. ID. NO: 69, SEQ. ID NO: 70, SEQ. ID NO: 71, SEQ. ID NO: 72, SEQ. ID. NO: 73, SEQ. ID NO: 74, SEQ. ID. NO: 94, SEQ. ID NO: 95, SEQ. ID NO: 96, SEQ. ID NO: 97, SEQ. ID. NO: 98, SEQ. ID NO: 99, SEQ. ID NO: 100, SEQ. ID NO: 101, SEQ. ID NO: 102, SEQ. ID NO: 103, SEQ. ID. NO: 104, SEQ. ID NO: 105, SEQ. ID NO: 106, SEQ. ID NO: 107, SEQ. ID. NO: 108, SEQ. ID NO: 109, SEQ. ID NO: 110, SEQ. ID NO: 111, SEQ. ID NO: 112, SEQ. ID NO: 506 to SEQ. ID NO: 765 or SEQ. ID NO: 768 to SEQ. ID NO: 901 and with a nucleic acid probe capable of hybridizing to a polynucleotide sequence encoding the foregoing. Generally, the sample is a plant sample, and in some embodiments, a sample suspected of comprising a *Papaver somniferum* nucleic acid sequence encoding polynucleotides of the present disclosure. The polynucleotide probe selectively hybridizes, under stringent conditions, to a subsequence of the nucleic acid sequence encoding the polypeptide comprising a polymorphic marker. Selective hybridization of the polynucleotide probe to the polymorphic marker nucleic acid sequence yields a hybridization complex. Detection of the hybridization complex indicates the presence of that polymorphic marker in the sample. In preferred embodiments, the polynucleotide probe comprises a portion of a nucleic acid sequence encoding polypeptide of the present disclosure.

The alkaloids obtained in accordance with the present disclosure may be formulated for use as a pharmaceutical drug, therapeutic agent or medicinal agent. Thus the present disclosure further includes a pharmaceutical composition comprising an alkaloid compound prepared in accordance with the methods of the present disclosure. Pharmaceutical drug preparations comprising an alkaloid in accordance with the present disclosure preferably further comprise vehicles, excipients and auxiliary substances, such as wetting or emulsifying agents, pH buffering substances and the like. These vehicles, excipients and auxiliary substances are generally pharmaceutical agents that may be administered without undue toxicity. Pharmaceutically acceptable excipients include, but are not limited to, liquids such as water, saline, polyethyleneglycol, hyaluronic acid, glycerol and ethanol. Pharmaceutically acceptable salts can also be included therein, for example, mineral acid salts such as hydrochlorides, phosphates, sulfates, and the like; and the salts of organic acids such as acetates, propionates, benzoates, and the like. It is also preferred, although not required, that the preparation will contain a pharmaceutically acceptable excipient that serves as a stabilizer. Examples of suitable carriers that also act as stabilizers for peptides include, without limitation, pharmaceutical grades of dextrose, sucrose, lactose, sorbitol, inositol, dextran, and the like. Other suitable carriers include, again without limitation, starch, cellulose, sodium or calcium phosphates, citric acid, glycine, polyethylene glycols (PEGs), and combinations thereof. The pharmaceutical composition may be formulated for oral and intravenous administration and other routes of administration as desired. Dosing may vary and may be optimized using routine experimentation.

In further embodiments, the present disclosure provides an alkaloid for use as a precursor and raw material to form a second alkaloid compound which may be formulated for use as a pharmaceutical drug, therapeutic agent or medicinal agent.

EXAMPLES

Hereinafter are provided examples of specific embodiments for performing the methods of the present disclosure, as well as embodiments representing the compositions of the present disclosure. The examples are provided for illustrative purposes only, and are not intended to limit the scope of the present disclosure in any way.

Example 1—Identification of Polynucleotides

Plant Genomic DNA Extraction—One gram of frozen *Papaver somniferum* seedlings at the cotyledonary stage was ground to a fine powder under liquid $N_2$. Pre-warmed (65° C.) CTAB (cetyltrimethyl ammonium bromide) buffer (2% (w/v) CTAB, 100 mM Tris-HCl, pH 8.0, 2.0 M NaCl, 25 mM EDTA, pH 8.0, 1% (w/v) PVP, 2% (v/v) 2-mercaptoethanol, was added to the powdered tissue. The mixture was incubated at 65° C. for 30 minutes with occasional vertex and extracted twice with an equal volume of chloroform: isoamyl alcohol (24:1, v/v). The upper aqueous phase was transferred to a clean tube. Genomic DNA was precipitated with the addition of equal volume of −20° C. isopropanol. After incubation at 4° C. for 30 minutes, the mixture was centrifuged at 13,000 g for 20 minutes at 4° C. The DNA pellet was dissolved in 2 mL of TE buffer and treated with 5 µL of RNaseA at 37° C. for 20 minutes. The mixture was again extracted with equal volume of chloroform:isoamyl alcohol (24:1, v/v). Genomic DNA in the extracted upper aqueous phase was precipitated by the addition of sodium acetate (pH 5.3) at final concentration of 0.3 M and equal volume of −20° C. isopropanol. After incubation at 4° C. for 20 minutes, the mixture was centrifuged at 13,000 g for 20 minutes at 4° C. The DNA pellet was washed three times with 70% (v/v) ethanol, followed by speed vacuum drying. Finally, the DNA pellet was dissolved in TE buffer.

Genomic DNA Sequencing—*Papaver somniferum* genomic DNA was subjected to (i) short-read sequencing, which generated between 30 to 210 million 100 bp Paired-End or Mate-Pair reads from the Illumina HiSeq 2000/2500 sequencer per readset. The read base quality was encoded in phred 33 and (ii) long-read sequencing, which generated between 20,000 to 200,000 sub-reads from PacBio RS II sequencer per readset. The average length of sub-reads varied from 3 to 8 kb per readset. The analytical pipeline was executed on Compute Canada clusters via unix bash commands, perl scripts, python scripts and open source software. Paired-End reads were trimmed from the 3' end to have a phred score of at least 30. Illumina sequencing adapters were removed from the reads, and all reads were required to have a length of at least 50 bp. Trimming and clipping were done with the Trimmomatic software (Bolger, et al., 2014, *Bioinformatics* 30:2114-2120). The Illumina Nextera Mate Pair protocol employs a circularisation-based strategy that leaves behind 38 bp adapter sequences, which must be computationally removed from the data. The 3' ward portion of the read constitutes valuable sequence that can be retained to improve coverage and de novo assembly quality. Depending on where the adapter lies in the read, the paired sequences should be reinterpreted as a single read plus either a mate pair or a paired-end read, choosing between the latter two options so as to maximise the number of bases that are paired. The Mate Pair specific trimming was done using the Nxtrim software (O'Connell, et al., 2015, *Bioinformatics* 31:2035-2037). The filtered reads were assembled to create the first consensus sequence. The assembly was done using the information of every Paired-End readset through a deBruijn graph approach. The better assembly was achieved by exploring the set of kmer possibility ranging from 21 to 91 and selecting the one that provided the best set of contigs. In a second step, the information brought by the Mate-Pair readset was incorporated to scaffold the consensus sequence. The scaffolding involved use of large DNA fragment sequencing information (the mate-pair sample) to join the contigs into scaffolds. Scaffolds can be full length DNA sequence but can also contain unresolved ambiguous sequence inserted as long stretches of N's. The use of mate-pair allows an estimate of the distance between contigs in the organism genome. If a gap can be filled-up by one or more specific contigs, the scaffolds would represent full-length DNA sequences. Otherwise, the scaffolds will include a stretch of N's corresponding to estimate the distance between contigs. The assembly and scaffolding software used was SOAPdenovo (Luo, et al., 2012, *Gigascience* 1:18). Pacific Biosciences SMART analysis software was used to generate 'filtered sub-reads' from the instrument. The term 'sub-read' refers to the portion of a read from a single pass of the template. Filtering refers to a process within the software to identify quality reads. Filtered sub-reads were generated following primary analysis where the SMART bell adaptors are separated from the long raw reads, and low quality bases reported by the instrument are removed. Once the scaffolding with Mate-Pair was completed, a scaffolding of the consensus sequence was performed with assembled Rnaseq data (EST) using SCUBAT pipeline. SCUBAT will align the transcripts to the genome and identify informative split transcripts mapped to more than one contig. It then will create scaffolds by orienting the contig based on the alignment information and adding 10 N's in-between the contigs. Once the scaffolding with EST was done, a scaffolding and gap filling of the consensus sequence was performed with filtered PacBio data using PBjelly (English, et al., 2012, *PLoS One* 7:e47768). PBJelly maps the long-reads to the reference with the PacBio data error model under consideration, though BLASR. Alignment information is parsed and serves to identify reads that fill gaps. After the gap-supporting sequence reads were identified, PBJelly assembled the reads for each gap to generate a high quality gap-filling consensus sequence. The final consensus sequence was then annotated by mapping assembled EST to the reference sequence using BLAT (Kent, 2002, *Genome Res* 12:656-664). This step generated a high level of noise due to partial mapping of protein domains. A filter was applied only to conserve the results of the most relevant hits. Only hits of more than 21 bp, which aligned to more than 80% of EST lengths, were retained. Duplicate hits with same start and end positions that another existing hit were removed. All exisiting EST and protein sequence corresponding to *Papaver somniferum* were downloaded from the NCBI website and used in combination with the assembled ESTs from the RNAseq data to perform an in-silico gene prediction using MAKER software (Cantarel, et al., 2008, *Genome Res* 18:188-196). MAKER identifies repeats, aligns ESTs and proteins to a genome, produces ab-initio gene predictions and automatically synthesizes these data into gene annotations having evidence-based quality values. During all the assembly process, summary statistics of the de Novo assemblies were computed to ensure a sufficient level of quality of the consensus sequence. The summary statistics are computed using the QUAST software (Gurevich, et al., 2013, *Bioinformatics* 29:1072-1075).

Polynucleotide sequences: SEQ. ID NO: 1 to SEQ. ID NO: 23 and SEQ. ID NO: 47 to SEQ. ID NO: 93 set forth herein were obtained using the foregoing methodology Example 2—Identification of Additional Polynucleotides In order to further expand on the genomic sequences identified as described in Example 1, another sequencing methodology was used, namely the so called the "Chicago method" (Putnam, N. H. et al., 2016, Genome Res. 26, 342-350). In the performance of the Chicago method, the average scaffold length increased from 0.08 megabases to 0.93 megabases, and additional polynucleotides SEQ. ID NO: 113 to 505 and SEQ. ID NO: 766 set forth herein were identified.

Example 3—Expression of Polynucleotides in Engineered Yeast

To exploit the physiological functions of novel genes, yeast platform strains with chromosome-integrated BIA biosynthetic genes were constructed using a USER cloning system. USER (uracil-specific excision reaction)-based cloning have been used for the integration of multiple genes into the yeast genome owing to its relatively straightforward application and independence from the enzyme-based ligation of DNA fragments (Nour-Eldin et al., 2006, Nucleic Acids Research 34:e122). A comprehensive review of USER-based cloning methods, including a one-step procedure for multi-part DNA-construct assembly termed 'USER fusion', is available (Nour-Eldin et al., 2010, Methods Mol Biol 643:185-200). Multiple PCR products of BIA biosynthetic genes and Gal1/Gal10 promoter regions were simultaneous cloned to the USER cloning vectors initially nicked with AsiSI and Nb.BsmI and then transformed into yeast cells using the LiAc/PEG/single-stranded carrier DNA (ssDNA) transformation method (Gietz and Schiestl, 2007, Nature Protocols 2:35-37). The high-copy number pESC-Ura (or, alternatively, pESC-Leu or pESC-His) vector was used to express gene candidates using the Gal10 promoter. PCR-amplified candidate genes from cDNA using primers flanked with SpeI and NotI restriction sites were ligated to the pESC-Ura vector to generate transient expressing constructs. Transient expression constructs were individually transformed to the platform yeast strains with chromosome-integrated BIA biosynthetic genes using the LiAc/PEG/single-stranded carrier DNA (ssDNA) transformation method (Gietz and Schiestl, 2007). Each yeast strain transiently expressing a different candidate gene was incubated in SD-drop out medium overnight. The overnight culture were then diluted into a SD-drop out medium containing 2% (w/v) galactose and 200 µM of the BIA suitable for conversion by the baseline yeast strain or the transient expression construct. Yeast cultures were grown for 24 and 48 h, and cells were removed by centrifugation. Supernatant aliquots (5 µL), which contained alkaloids secreted by the yeast cells into the culture medium, were subjected to high-resolution mass spectrometry analysis.

Figure 5:
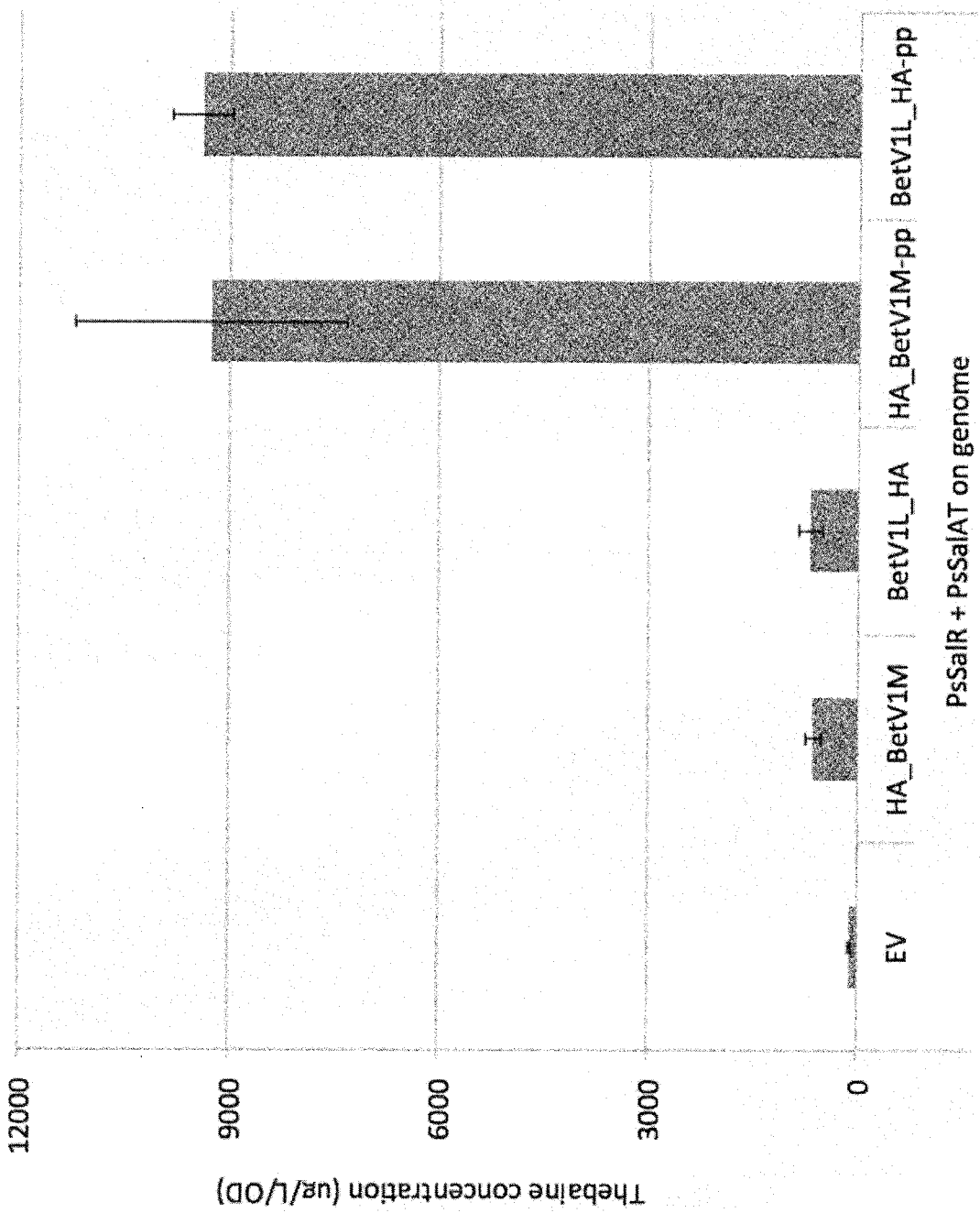
FIG. 5 depicts a graph showing concentrations of thebaine (µg/l/OD) present in growth medium comprising salutardine following growth of different yeast strains expressing Betv-1 alone (HA_BetV1M and BetViL_HA), or Betv-1 together with purine permease (HA_BetV1M-pp and BetV1L_HA-pp), as well as a control (EV).

Example 4—Expression of Betv-1 in Yeast Expressing SalAT and SalR Genes, and Fed Salutaridine, and Co-Expression of Betv-1 and Purine Permease in Yeast Expressing SalAT and SalR Genes, and Fed Salutaridine A *Saccharomyces cerevisiae* strain CENPK102-5B expressing salutaridinol 7-O-acetyltransferase (SalAT) and salutaridine reductase (SalR) genes integrated into the yeast genome was transformed with a yeast expression vector pEV-1 harboring various polynucleotide constructs expressing Betv-1 and purine permease polypeptides as follows: (i) a nucleic acid sequence encoding Betv-1 alone (SEQ. ID NO: 29) (HA_BetV1M); (ii) a nucleic acid sequence encoding Betv-1 alone (SEQ. ID NO: 900) (BETV1L_HA); a nucleic acid sequence expressing Betv-1 (SEQ. ID NO: 29) and purine permease (SEQ. ID NO: 779) (HA_BetV1M-pp); and (iv) a nucleic acid sequence expressing Betv-1 (SEQ. ID NO: 900) and purine permease (SEQ. ID NO: 779) (BetV1L_HA-pp). The strains, as well as a control strain with pEV-1 not comprising a nucleic acid sequences encoding Betv-1 or purine permease (EV) were separately cultivated in growth medium SD-Leu-His in the presence of 100 µM salutardine for 24 hrs. An aliquot of 5 µL of culture medium was subjected to mass spectrometry analysis using an LTQ-Orbitrap XL high-resolution mass spectrometer. Thereafter the thebaine concentration in the medium of each strain was determined according to a thebaine standard curve. The results are shown in FIG. 5. As can be seen in FIG. 5, thebaine production increased 6-fold (to approximately 600 µg/L/OD) in the medium containing strains transformed with only a Betv-1 (HA_BetV1M and BETV1L_HA) compared with strains expressing only SalAT and SalR. However, and surprisingly, in excess of 9,000 µg/L/OD thebaine was detected in the medium containing strains transformed with both Betv_1 and purine permease (HA_BetV1M-pp and BetV1L_HA-pp), thus, generating an additional 16-fold increase compared with strains with only a Betv-1 (HA_BetV1M and BETV1L_HA). The production of thebaine increased approximately 100-fold in strains transformed with both Betv_1 and purine permease (HA_BetV1M-pp and BetV1L_HA-pp) compared with strains expressing only SalAT and SalR.

Figure 6:
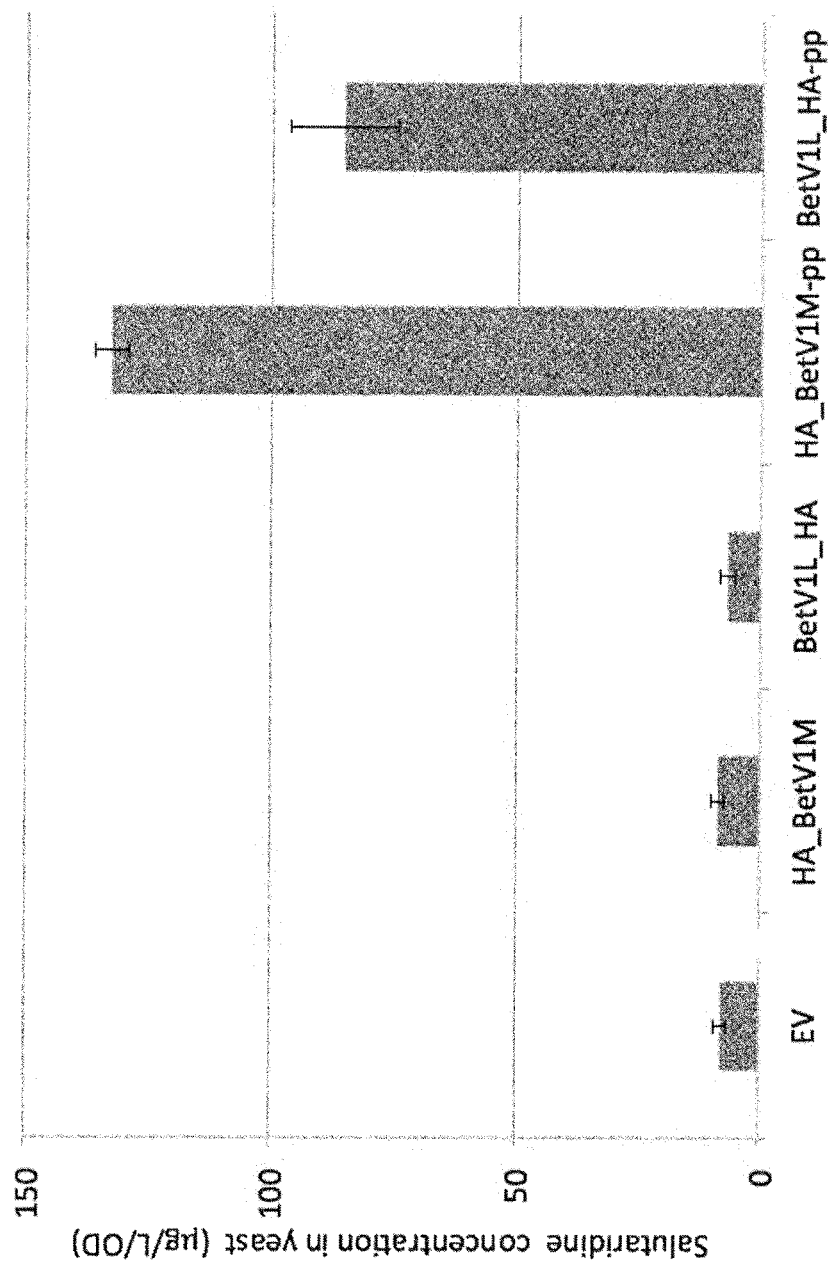
FIG. 6 depicts a graph showing salutardine (µg/l/OD) present in growth medium comprising salutardine following growth of different yeast strains expressing Betv-1 alone (HA_BetV1M and BetViL_HA), or Betv-1 together with purine permease (HA_BetV1M-pp and BetV1L_HA-pp), as well as a control (EV).

Example 5—Expression of Betv-1 in Yeast and Co-Expression of Betv-1 and Purine Permease in Yeast, Fed Salutaridine A *Saccharomyces cerevisiae* strain CENPK102-5B was transformed with a yeast expression vector pEV-1 harboring various polynucleotide constructs expressing Betv-1 and purine permease polypeptides as follows: (i) a nucleic acid sequence encoding Betv-1 alone (SEQ. ID NO: 29) (HA_BetV1M); (ii) a nucleic acid sequence encoding Betv-1 alone (SEQ. ID NO: 900) (BETV1L_HA); a nucleic acid sequence expressing Betv-1 (SEQ. ID NO: 29) and purine permease (SEQ. ID NO: 779) (HA_BetV1M-pp); and (iv) a nucleic acid sequence expressing Betv-1 (SEQ. ID NO: 900) and purine permease (SEQ. ID NO: 779) (BetV1L_HA-pp). The strains, as well as a control strain with pEV-1 not comprising a nucleic acid sequences encoding Betv-1 or purine permease (EV) were separately cultivated in growth medium SD-Leu-His in the presence of 100 µM salutardine for 24 hrs. Yeast cells were collected by centrifugation, extracted in 500 µL of methanol, of which 5 µL was subjected to mass spectrometry analysis using an LTQ-Orbitrap XL high-resolution mass spectrometer. Thereafter the salutaridine concentration in the cells of each strain was determined according to a salutaridine standard curve. The results are shown in FIG. 6. As can be seen in FIG. 6, salutaridine accumulation increased 8-fold (to approximately 132 µg/L/OD) in the cells of strains transformed with a Betv-1 (HA_BetV1M and BETV1L_HA) and a purine permease (HA_BetV1M-pp and HA_BetV1L-pp). Compared with the empty vector (EV) control, salutaridine accumulation did not increase in cells transformed only with a Betv-1 (HA_BetV1M and BETV1L_HA).

Example 6—Expression of Purine Permeases (PUP-L) and (PUP-N) in Yeast Expressing DODC, MAO, NCS, 6OMT, CNMT and 4'OMT Genes, and Fed Either L-DOPA or Norlaudanosoline (NLDS), and Co-Expression of PUP-L and PUP-N with a Betv1 in Yeast Expressing DODC, MAO, NCS, 6OMT, CNMT and 4'OMT Genes, and Fed Either DOPA or Norlaudanosoline (NLDS)

Figure 7:
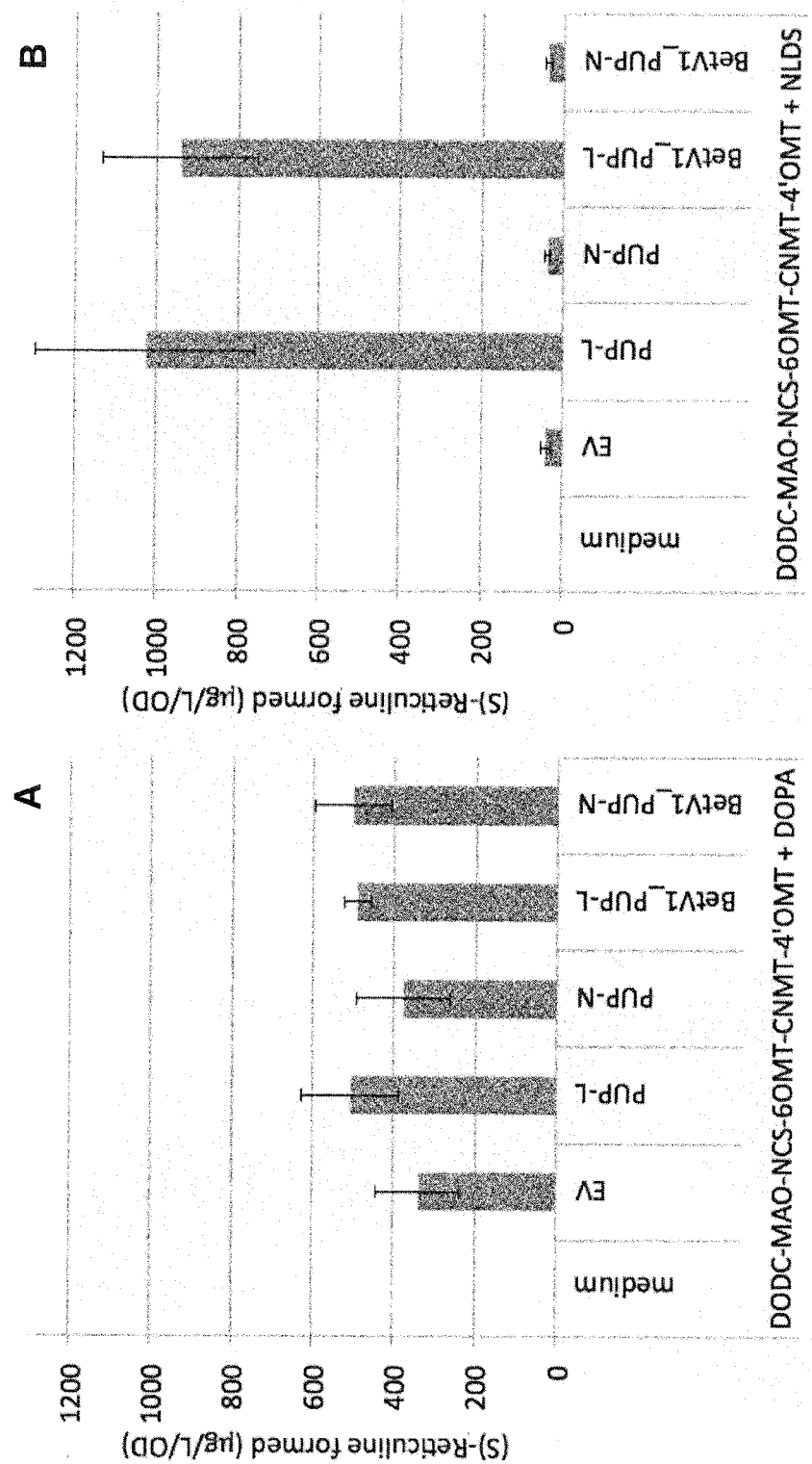
FIG. 7 depicts a graph showing reticuline (µg/l/OD) present in a growth medium comprising either DOPA (A) or norlaudanosoline (NLDS) (B), following growth of yeast strains expressing DODC, MAO, NCS, 6OMT, CNMT and 4'OMT genes, and transformed with a gene expressing a first purine permease (PUP-L) or a second purine permease (PUP-N), each either alone or together with Betv-1.

A *Saccharomyces cerevisiae* strain CENPK102-5B expressing dopa decarboxylase (DODC), monoamine oxidase (MAO), norcoclaurine synthase (NCS), norcoclaurine 6-O-methyltransferase (6OMT), coclaurine N-methyltransferase (CNMT), and 3'hydroxy-N-methyltransferase 4'-O-methyltransferase (4'OMT) genes integrated into the yeast genome was transformed with a yeast expression vector pEV-1 harboring various polynucleotide constructs expressing purine permease and Betv1 polypeptides as follows: (i) a nucleic acid sequence encoding a purine permease containing a C-terminal extension absent in a purine permease linked to a cluster of 10 noscapine biosynthetic genes (Winzer, T., Gazda, V., He Z., Kaminski F., Kern M., Larson T. R., Li Y., Meade F., Teodor R., Vaistij F. E., Walker C., Bowser T. A., Graham, I. A. (2012) A *Papaver somniferum* 10-gene cluster for synthesis of the anticancer alkaloid noscapine. Science 336(6089): 1704-1708) alone (SEQ. ID NO: 779) (PUP-L); (ii) a nucleic acid sequence encoding a purine permease linked to a cluster of 10 noscapine biosynthetic genes (Winzer et al., 2012) alone (SEQ. ID NO: 901) (PUP-N) (nucleic acid sequence SEQ. ID NO: 902 was codon optimized and C-terminally myc-tagged to obtain nucleic acid sequence SEQ. ID NO: 903 (myc-tag sequence SEQ. ID NO: 904)); (iii) a nucleic acid sequence expressing PUP-L (SEQ. ID NO: 779) and a Betv1 (SEQ. ID NO: 29) (Betv1-PUP-L); and (iv) a nucleic acid sequence expressing PUP-N(SEQ. ID NO: 901) and a Betv1 (SEQ. ID NO: 29) (Betv1-PUP-N). The strains, as well as a control strain with pEV-1 not comprising a nucleic acid sequences encoding Betv-1 or purine permease (EV) were separately cultivated in growth medium SD-Leu-His in the presence of either 100 µM L-DOPA or 100 µM norlaudanosoline (NLDS) for 24 hrs. An aliquot of 5 µL of culture medium was subjected to mass spectrometry analysis using an LTQ-Orbitrap XL high-resolution mass spectrometer. Thereafter the reticuline concentration in the medium of each strain was determined according to a reticuline standard curve. The results are shown in FIG. 7. As can be seen in FIG. 7, reticuline production was not affected in the medium of strains transformed with only a purine permease (PUP-L or PUP-N) or a purine permease and a Betv1 (Betv1_PUP-L and Betv1_PUP-N) compared with strains expressing only DODC, MAO, NCS, 6OMT, CNMT and 4'OMT. However, and surprisingly, reticuline production increased 25-fold to more than 1,000 µg/L/OD in the medium containing strains transformed with both PUP-L and PUP-L and Betv1. Neither PUP-N nor Betv1 alone affected the production of reticuline compared with empty vector controls.

Example 7—Expression of Purine Permeases (PUP-L) and (PUP-N) in Yeast Expressing REPI, CPR, and SalSyn Genes or REPI, CPR, SalSyn, SalR and SalAT Genes, and Fed (S)-Reticuline, and Co-Expression of PUP-L and PUP-N with a Betv1

Figure 8:
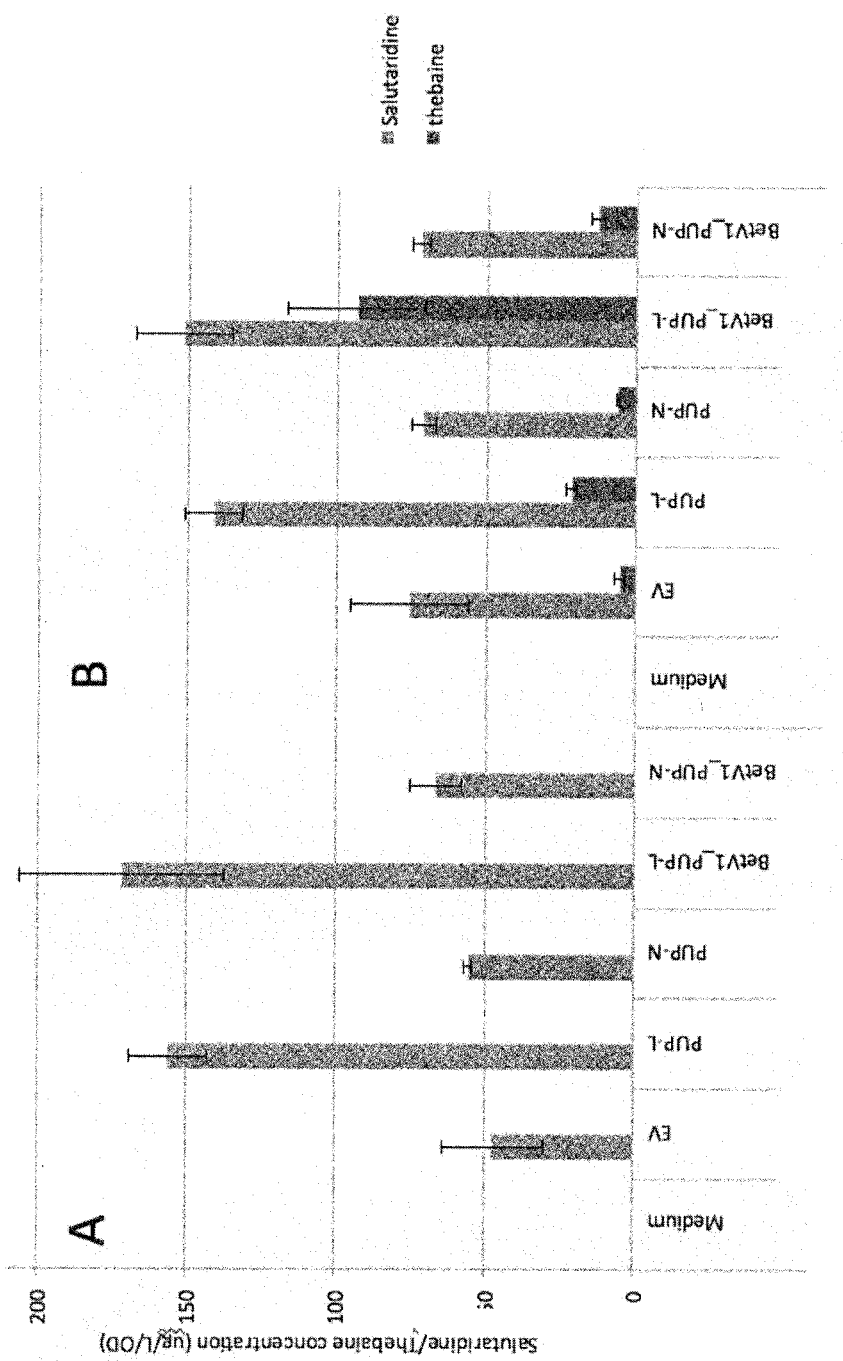
FIG. 8 depicts a graph showing reticuline and thebaine (µg/l/OD) present in a growth medium comprising (S)-reticuline in a yeast expressing REPI, CPR and SalSyn (A) or REPI, CPR, SalSyn, SalAT and SalR (B), each yeast strain transformed with a first purine permease (PUP-L) or a second purine permease (PUP-N), each either alone or together with Betv-1.

A *Saccharomyces cerevisiae* strain CENPK102-5B expressing reticuline epimerase (REPI), cytochrome P450 reductase (CPR) and salutarine synthase (SalSyn) genes integrated into the yeast genome was transformed with a yeast expression vector pEV-1 harboring various polynucleotide constructs expressing purine permease and Betv1 polypeptides as follows: (i) a nucleic acid sequence encoding a purine permease containing a C-terminal extension absent in a purine permease linked to a cluster of 10 noscapine biosynthetic genes (Winzer et al., 2012) alone (SEQ. ID NO: 779) (PUP-L); (ii) a nucleic acid sequence encoding a purine permease linked to a cluster of 10 noscapine biosynthetic genes (Winzer et al., 2012) alone (SEQ. ID NO: 901) (PUP-N); (iii) a nucleic acid sequence expressing PUP-L (SEQ. ID NO: 779) and a Betv1 (SEQ. ID NO: 29) (Betv1-PUP-L); and (iv) a nucleic acid sequence expressing PUP-N(SEQ. ID NO: 901) and a Betv1 (SEQ. ID NO: 29) (Betv1-PUP-N). The strains, as well as a control strain with pEV-1 not comprising a nucleic acid sequences encoding Betv-1 or purine permease (EV) were separately cultivated in growth medium SD-Leu-His in the presence of 100 µM (S)-reticuline for 24 hrs. An aliquot of 5 µL of culture medium was subjected to mass spectrometry analysis using an LTQ-Orbitrap XL high-resolution mass spectrometer. Thereafter the salutaridine and thebaine concentrations in the medium of each strain were determined according to salutaridine and thebaine standard curves, respectively. The results are shown in FIG. 8A. As can be seen in FIG. 8A, salutaridine production was not affected in the medium of strains transformed with PUP-N, or PUP-N and a Betv1 (Betv1_PUP-N) compared with strains expressing only REPI, CPR, and SalSyn. However, and surprisingly, salutaridine production increased 3-fold compared with the empty vector (EV) control to more than 150 µg/L/OD in the medium containing strains transformed with either PUP-L alone or PUP-L and a Betv1 (Betv1_PUP-L). B, A *Saccharomyces cerevisiae* strain CENPK102-5B expressing reticuline epimerase (REPI), cytochrome P450 reductase (CPR), salutarine synthase (SalSyn), salutaridine reductase (SalR), and salutaridine acetyltransferase (SalAT) genes integrated into the yeast genome was transformed with a yeast expression vector pEV-1 harboring various polynucleotide constructs expressing purine permease and Betv1 polypeptides as follows: (i) a nucleic acid sequence encoding a purine permease containing a C-terminal extension absent in a purine permease linked to a cluster of 10 noscapine biosynthetic genes (Winzer et al., 2012) alone (SEQ ID NO: 779) (PUP-L); (ii) a nucleic acid sequence encoding a purine permease linked to a cluster of 10 noscapine biosynthetic genes (Winzer et al., 2012) alone (SEQ. ID NO: 901) (PUP-N); (iii) a nucleic acid sequence expressing PUP-L (SEQ. ID NO: 779) and a Betv1 (SEQ. ID NO: 29) (Betv1-PUP-L); and (iv) a nucleic acid sequence expressing PUP-N(SEQ. ID NO: 901) and a Betv1 (SEQ. ID NO: 29) (Betv1-PUP-N). The strains, as well as a control strain with pEV-1 not comprising a nucleic acid sequences encoding Betv-1 or purine permease (EV) were separately cultivated in growth medium SD-Leu-His in the presence of 100 µM (S)-reticuline for 24 hrs. An aliquot of 5 µL of culture medium was subjected to mass spectrometry analysis using an LTQ-Orbitrap XL high-resolution mass spectrometer. Thereafter the salutaridine and thebaine concentrations in the medium of each strain were determined according to salutaridine and thebaine standard curves, respectively. The results are shown in FIG. 8B. As can be seen in FIG. 8B, salutaridine and thebaine production was not affected in the medium of strains transformed with PUP-N compared with strains expressing only REPI, CPR, SalSyn, SalR and SalAT. However, and surprisingly, salutaridine production increased 2-fold compared with the empty vector (EV) control to approximately 150 µg/L/OD in the medium containing strains transformed with either PUP-L alone or PUP-L and a Betv1 (Betv1_PUP-L). Thebaine production increased 4-fold compared with the empty vector (EV) control in the medium containing strains transformed with PUP-L alone. Thebaine production increased almost 20-fold compared with the empty vector (EV) control to approximately 95 µg/L/OD in the medium containing strains transformed with PUP-L and a Betv1 (Betv1_PUP-L). Thebaine production increased approximately 2-fold compared with the empty vector (EV) control to approximately 12 µg/L/OD in the medium containing strains transformed with PUP-N and a Betv1 (Betv1_PUP-L) owing to the thebaine-forming activity of Betv1.

Example 8—Expression of a Purine Permeases (PUP-L) and (PUP-N) in Yeast Expressing REPI, CPR, and SalSyn Genes or REPI, CPR, SalSyn, SalR and SalAT Genes, and Fed (R)-Reticuline, and Co-Expression of PUP-L and PUP-N with Betv1

Figure 9:
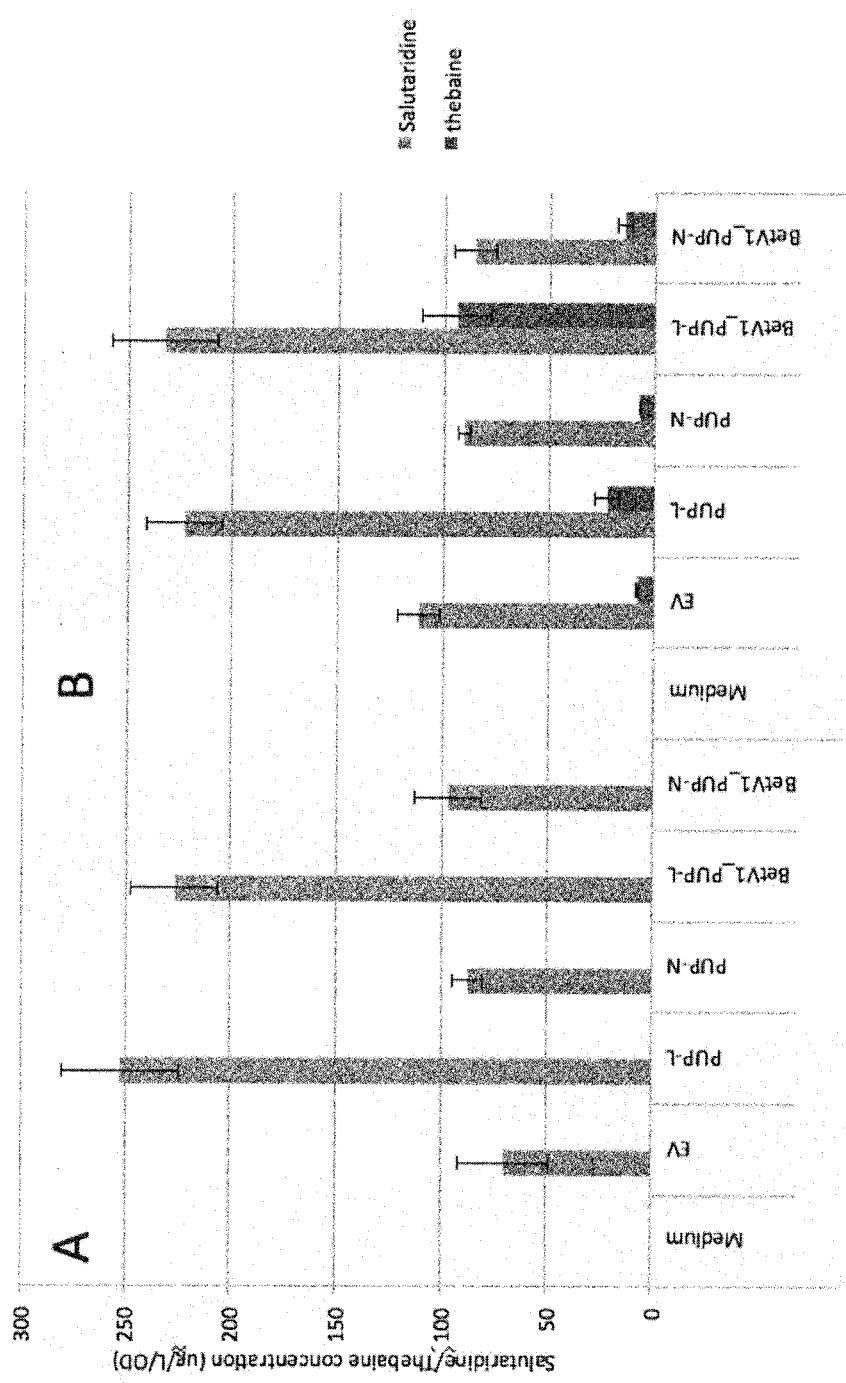
FIG. 9 depicts a graph showing reticuline and thebaine (µg/l/OD) present in a growth medium comprising (R)-reticuline in a yeast expressing REPI, CPR and SalSyn (A) or REPI, CPR, SalSyn, SalAT and SalR (B), each yeast strain transformed with a first purine permease (PUP-L) or a second purine permease (PUP-N), each either alone or together with Betv-1.

A *Saccharomyces cerevisiae* strain CENPK102-5B expressing reticuline epimerase (REPI), cytochrome P450 reductase (CPR) and salutarine synthase (SalSyn) genes integrated into the yeast genome was transformed with a yeast expression vector pEV-1 harboring various polynucleotide constructs expressing purine permease and Betv1 polypeptides as follows: (i) a nucleic acid sequence encoding a purine permease containing a C-terminal extension absent in a purine permease linked to a cluster of 10 noscapine biosynthetic genes (Winzer et al., 2012) alone (SEQ. ID NO: 779) (PUP-L); (ii) a nucleic acid sequence encoding a purine permease linked to a cluster of 10 noscapine biosynthetic genes (Winzer et al., 2012) alone (SEQ. ID NO: 901) (PUP-N); (iii) a nucleic acid sequence expressing PUP-L (SEQ. ID NO: 779) and a Betv1 (SEQ. ID NO: 29) (Betv1-PUP-L); and (iv) a nucleic acid sequence expressing PUP-N(SEQ. ID NO: 901) and a Betv1 (SEQ. ID NO: 29) (Betv1-PUP-N). The strains, as well as a control strain with pEV-1 not comprising a nucleic acid sequences encoding Betv-1 or purine permease (EV) were separately cultivated in growth medium SD-Leu-His in the presence of 100 µM (R)-reticuline for 24 hrs. An aliquot of 5 µL of culture medium was subjected to mass spectrometry analysis using an LTQ-Orbitrap XL high-resolution mass spectrometer. Thereafter the salutaridine and thebaine concentrations in the medium of each strain were determined according to salutaridine and thebaine standard curves, respectively. The results are shown in FIG. 9A. As can be seen in FIG. 9A, salutaridine production was not affected in the medium of strains transformed with PUP-N, or PUP-N and a Betv1 (Betv1_PUP-N) compared with strains expressing only REPI, CPR, and SalSyn. However, and surprisingly, salutaridine production increased 3-fold compared with the empty vector (EV) control to more than 150 µg/L/OD in the medium containing strains transformed with either PUP-L alone or PUP-L and a Betv1 (Betv1_PUP-L). B, A Saccharomyces cerevisiae strain CENPK102-5B expressing reticuline epimerase (REPI), cytochrome P450 reductase (CPR), salutarine synthase (SalSyn), salutaridine reductase (SalR), and salutaridine acetyltransferase (SalAT) genes integrated into the yeast genome was transformed with a yeast expression vector pEV-1 harboring various polynucleotide constructs expressing purine permease and Betv1 polypeptides as follows: (i) a nucleic acid sequence encoding a purine permease containing a C-terminal extension absent in a purine permease linked to a cluster of 10 noscapine biosynthetic genes (Winzer et al., 2012) alone (SEQ. ID NO: 779) (PUP-L); (ii) a nucleic acid sequence encoding a purine permease linked to a cluster of 10 noscapine biosynthetic genes (Winzer et al., 2012) alone (SEQ. ID NO: 901) (PUP-N); (iii) a nucleic acid sequence expressing PUP-L (SEQ. ID NO: 779) and a Betv1 (SEQ. ID NO: 29) (Betv1-PUP-L); and (iv) a nucleic acid sequence expressing PUP-N(SEQ. ID NO: 901) and a Betv1 (SEQ. ID NO: 29) (Betv1-PUP-N). The strains, as well as a control strain with pEV-1 not comprising a nucleic acid sequences encoding Betv-1 or purine permease (EV) were separately cultivated in growth medium SD-Leu-His in the presence of 100 µM (R)-reticuline for 24 hrs. An aliquot of 5 µL of culture medium was subjected to mass spectrometry analysis using an LTQ-Orbitrap XL high-resolution mass spectrometer. Thereafter the salutaridine and thebaine concentrations in the medium of each strain were determined according to salutaridine and thebaine standard curves, respectively. The results are shown in FIG. 9B. As can be seen in FIG. 9B, salutaridine and thebaine production was not affected in the medium of strains transformed with PUP-N compared with strains expressing only REPI, CPR, SalSyn, SalR and SalAT. However, and surprisingly, salutaridine production increased 2-fold compared with the empty vector (EV) control to approximately 150 µg/L/OD in the medium containing strains transformed with either PUP-L alone or PUP-L and a Betv1 (Betv1_PUP-L). Thebaine production increased 4-fold compared with the empty vector (EV) control in the medium containing strains transformed with PUP-L alone. Thebaine production increased almost 20-fold compared with the empty vector (EV) control to approximately 95 µg/L/OD in the medium containing strains transformed with PUP-L and a Betv1 (Betv1_PUP-L). Thebaine production increased approximately 2-fold compared with the empty vector (EV) control to approximately 12 µg/L/OD in the medium containing strains transformed with PUP-N and a Betv1 (Betv1_PUP-N) owing to the thebaine-forming activity of Betv1.

Example 9—Expression of Purine Permeases (PUP-L) and (PUP-N) in Yeast Expressing SalAT and SalR Genes or REPI, CPR, SalSyn, SalR and SalAT Genes, and Fed Salutardine and Co-Expression of PUP-L and PUP-N with a Betv1

Figure 10:
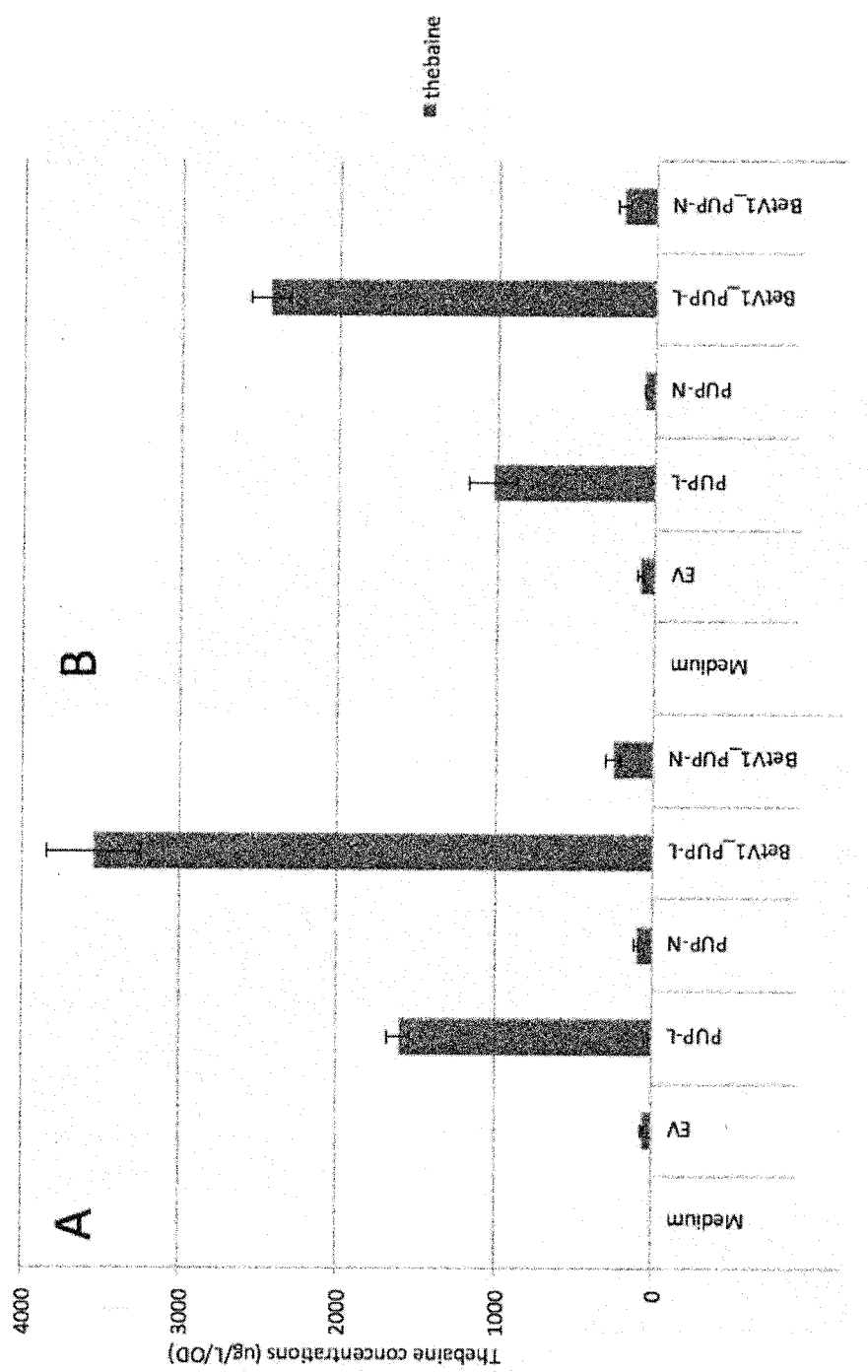
FIG. 10 depicts a graph showing thebaine (µg/l/OD) present in a growth medium comprising salutardine in a yeast expressing SalR and SalAT (A) or REPI, CPR, SalSyn, SalAT and SalR (B), each yeast strain transformed with a first purine permease (PUP-L) or a second purine permease (PUP-N), each either alone or together with Betv-1.

A Saccharomyces cerevisiae strain CENPK102-5B expressing salutaridine reductase (SalR) and salutaridine acetyltransferase (SalAT) genes integrated into the yeast genome was transformed with a yeast expression vector pEV-1 harboring various polynucleotide constructs expressing purine permease and Betv1 polypeptides as follows: (i) a nucleic acid sequence encoding a purine permease containing a C-terminal extension absent in a purine permease linked to a cluster of 10 noscapine biosynthetic genes (Winzer et al., 2012) alone (SEQ. ID NO: 779) (PUP-L); (ii) a nucleic acid sequence encoding a purine permease linked to a cluster of 10 noscapine biosynthetic genes (Winzer et al., 2012) alone (SEQ. ID NO: 901) (PUP-N); (iii) a nucleic acid sequence expressing PUP-L (SEQ. ID NO: 779) and a Betv1 (SEQ. ID NO: 29) (Betv1-PUP-L); and (iv) a nucleic acid sequence expressing PUP-N(SEQ. ID NO: 901) and a Betv1 (SEQ. ID NO: 29) (Betv1-PUP-N). The strains, as well as a control strain with pEV-1 not comprising a nucleic acid sequences encoding Betv-1 or purine permease (EV) were separately cultivated in growth medium SD-Leu-His in the presence of 100 µM salutaridine for 24 hrs. An aliquot of 5 µL of culture medium was subjected to mass spectrometry analysis using an LTQ-Orbitrap XL high-resolution mass spectrometer. Thereafter the thebaine concentration in the medium of each strain was determined according to a thebaine standard curve. The results are shown in FIG. 10A. As can be seen in FIG. 10A, thebaine production was not affected in the medium of strains transformed with PUP-N compared with strains expressing only SalR and SalAT. However, and surprisingly, thebaine production increased 27-fold and 60-fold compared with the empty vector (EV) control to more than 1600 and 3500 µg/L/OD in the medium containing strains transformed with either PUP-L alone or PUP-L and a Betv1 (Betv1_PUP-L), respectively. Thebaine production increased approximately 4-fold compared with the empty vector (EV) control to approximately 250 µg/L/OD in the medium containing strains transformed with PUP-N and a Betv1 (Betv1_PUP-N) owing to the thebaine-forming activity of Betv1. B, A Saccharomyces cerevisiae strain CENPK102-5B expressing reticuline epimerase (REPI), cytochrome P450 reductase (CPR), salutarine synthase (SalSyn), salutaridine reductase (SalR), and salutaridine acetyltransferase (SalAT) genes integrated into the yeast genome was transformed with a yeast expression vector pEV-1 harboring various polynucleotide constructs expressing purine permease and Betv1 polypeptides as follows: (i) a nucleic acid sequence encoding a purine permease containing a C-terminal extension absent in a purine permease linked to a cluster of 10 noscapine biosynthetic genes (Winzer et al., 2012) alone (SEQ. ID NO: 779) (PUP-L); (ii) a nucleic acid sequence encoding a purine permease linked to a cluster of 10 noscapine biosynthetic genes (Winzer et al., 2012) alone (SEQ. ID NO: 901) (PUP-N); (iii) a nucleic acid sequence expressing PUP-L (SEQ. ID NO: 779) and a Betv1 (SEQ. ID NO: 29) (Betv1-PUP-L); and (iv) a nucleic acid sequence expressing PUP-N(SEQ. ID NO: 901) and a Betv1 (SEQ. ID NO: 29) (Betv1-PUP-N). The strains, as well as a control strain with pEV-1 not comprising a nucleic acid sequences encoding Betv-1 or purine permease (EV) were separately cultivated in growth medium SD-Leu-His in the presence of 100 μM salutaridine for 24 hrs. An aliquot of 5 μL of culture medium was subjected to mass spectrometry analysis using an LTQ-Orbitrap XL high-resolution mass spectrometer. Thereafter the thebaine concentration in the medium of each strain was determined according to a thebaine standard curve. The results are shown in FIG. 10B. As can be seen in FIG. 10B, thebaine production was not affected in the medium of strains transformed with PUP-N compared with strains expressing only REPI, CPR, SalSyn, SalR and SalAT. However, and surprisingly, thebaine production increased 10-fold and 25-fold compared with the empty vector (EV) control to approximately 1000 and 2500 μg/L/OD in the medium containing strains transformed with either PUP-L alone or PUP-L and a Betv1 (Betv1_PUP-L), respectively. Thebaine production increased approximately 2-fold compared with the empty vector (EV) control to approximately 200 μg/L/OD in the medium containing strains transformed with PUP-N and a Betv1 (Betv1_PUP-N) owing to the thebaine-forming activity of Betv1.

SEQUENCE LISTING (904 sequences)

SEQ ID NO: 1 - DNA, 2703 bp, Papaver somniferum
atggagctccaatatatttcttattttcaaccaacttcctccgttgttgctcttctacttgctcttgtatccatcttatccagtgtcgttgttttgaggaagacatttttgaataactactcatcatcacctgcatcatccacaaaaacagcggtactttctcatcagcggcagcagtcgtgtgcattgccaatttccggtctcctccatattttcatgaataaaaacggcttaattcatgtaactcttggaaatatggctgataaatacggtccgattttcagtttcccaacaggtagccatagaactctcgttgtgagcagttgggagatggtaaaagagtgttttactggcaacaatgacactgctttctcaaaccgtcctatcccgttagcttttaagactatattctatgcatgcggtggcatagactcatacggtctttcgagtgtaccttatggaaaatattggagggagcttcgaaaggtctgtgtgcataacctcctgtctaatcaacaactactcaagttcagacacttgataatttctcaagtcgatacgtctttcaataagctgtatgagttatgcaaaaactctgaagacaaccagggaaactatcctactactactaccgcagctggcatggtgagaatcgatgattggctcgccgaattatcgttcaatgtgataggaagaatagtctgcggattccaatcaggccctaagacaggtgctccaagcagggtggaacaatttaaagaagcaattaatgaagcatcttattttatgtcgacatctccagtgtcagataatgttccaatgctagggtggattgaccaattgacaggtcttacgagaaatatgaagcactgcggaaagaaattagacttggtggtcgagagcataattaatgatcatcgtcaaaagagacgattctctagaactaaaggaggagatgagaaggacgatgaacaagatgacttcatcgacatttgtttgtcaataatggagcaaccacagcttcctggcaacaataatccttctcagatacctatcaaatctattgtcctggacatgataggtgggggcactgacaccacaaaactgaccaccatctggaccctttccttgctgctgaacaacccccatgtgttggacaaggcaaaacaagaagtggatgcacactttcgaaccaaaaggagatcaacaaatgatgcagcagcagccgtggtggattttgatgatattcgtaaccttgtctacatccaggcaatcatcaaagaatcaatgcggttgtatccagccagccccgtggtggagcgactgagcggcgaagattgtgtggtcggtgggtttcatgtaccagcagggacgagattatgggctaacgtatggaagatgcaacgagaccctaaagtatgggatgatccattggtgtttcgaccagacagatttttgagcgatgaacagaagatggttgatgtaaggggtcaaaattatgagctgttaccatttggagccggtcgacgtgtatgtccaggtgtatccttctctttggatctaatgcaactggtactgactcgtcttattctcgagtttgaaatgaagtctcctagcgggaaagtggacatgacagcaacaccaggattaatgagttacaaggtgatcccccttgacattctgctcacccatcgtcgcataaagccgtgtgtgcagtcagcagcctctgagagagacatggagagtagtggtgtaccagtaatcactctgggctcgggcaaggtgatgcctgttctgggcatgggaacatttgagaaagttggtaaagggtccgaaagagagaggttggcgattttaaaagcgatagaggtgggttacagatacttcgatacagctgctgcatacgaaactgaagaggttcttggagaagctattgctgaagcacttcaacttggcctagtcaaatctcgagatgaacttttcatcagttccatgctctggtgcactgatgctcacgctgatcgtgtcctcctcgctcttcagaattcgctgaggaatcttaaattggagtatgtggatctatatatgttacccttcccggcaagcttgaagcctgggaagataacgatggacataccagaggaagatatttgtcgcatggactacaggtctgtatgggcagccatggaagagtgtcaaaaccttggcttcactaaatcaatcggtgttagcaatttctcctgcaaaaagcttcaggaattgatggcgaccgccaacatccctccagctgtgaatcaagtggagatgagcccggctttccaacaaaagaagctgagagagtattgcaacgcaaataatatattagtcagtgcaatctctgtactgggatcaaacggaaccccatggggctccaatgcagttttgggttctgaggtgcttaagaaaattgctatggccaaaggaaaatctgttgctcaggttagtatgagatgggtttacgagcaaggcgcgagtcttgtggtaaaaagtttcagtgaagagagattgagggaaaacttgaacatatttgactgggaactcactaaggaagaccatgaaaagatcggtgagattccacagtgcagaatcttgagtgcttattttttggtctcacctaatggacctttcaaatctcaagaagagttgtgggatgatgaagcttga

SEQ ID NO: 2 - DNA, 1518 bp, Papaver somniferum
atggctccgattaatatagaggggaatgatttttggatgatagcatgcactgtcataatagtatttgcattggtgaagttcatgttttccaaaatatctttttatcaatctgcaaatacaacggaatggccagcaggtccaaaaacattacccataattggaaatcttcatcagttgggaggaggtgtgcccttacaggttgctttggcaaacttagctaaagtttatggaggtgcatttacaatttggattggaagctgggttccaatgatcgtcataagcgatatcgataacgctcgggaagttcttgttaataaatctgctgattattccgctagagatgtacctgatattcttaaaatcatcacagcaaatgggaagaatattgctgattgtgattctggtccattttggcataatttaaagaaaggtcttcaaagttgtataaatccatcaaatgttatgtctctatctcgtttacaggaaaaagacatgcaaaatctcatcaaatccatgcaagaaagagcgtcacagcataatggaattataaaacctcttgatcatgccaaagaagcgtctatgcgattgctgagtagagttatatttggtcacgacttttcaaatgaggatctcgttattggtgtgaaagacgccctcgatgagatggtacgcataagtgggttggcaagtttagctgatgcttttaaaattgctaaatatttaccaagccagagaaaaaatattcgggatatgtacgccacaagagacagagtatataatttgattcaaccacatatcgtccctaatcttcctgcaaattctttcttatattttcttacatctcaagattacagtgatgaaattatttactcaatggtacttgaaatttttggtttgggagtagatagtactgcagcaacggcagtttgggcactctcctttttagtcggcgagcaggaaattcaagaaaaactttaccgcgaaatcaacaaccggacgggtggacaaagaccagtgaaagttgtagatttgaaagagctgccatatctacaagccgtgatgaaagaaacattgaggatgaaacccatcgcaccactagcggtccctcatgtagcagcaaaagatactacattcaaggggcggagaatcgttaaaggtacaaaagtaatggtgaatctgtacgctatccatcacgaccctaacgttttccctgcaccgtataaattcatgccagagagattcttaaaggatgttaatagtgatggacgttttggtgatatcaacacaatggaaagttcgttgataccatttggtgctggtatgagaatttgtggaggtgtagaattagccaagcagatggtagcttttgctcttgcaagtatggtcaacgaattcaaatgggattgtgtttccgaggggaaattgcctgatcttagtgaagctattagcttcattctctacatgaaaaacccacttgaagccaaaattactcctcgtacaaaaccttttcgacagtag

SEQ ID NO: 3 - DNA, 1077 bp, Papaver somniferum
atggatatcaaattagaagatgaagaacaagaaataaaataccaaggtcatgtttggaacatgatctgcggtagtgtgaattcatccgtacttaaatgtacgattgttttaggtcttttcgatacaattcataattcatccaaacccatgaccctatcctccctatcatcagcatcaccatctttatctcctctcaaaaccgaaaacttatatagactattaagatacttatctcatatgaatctcatcgtaatcaattcaattcaaggaagtgatgatacattttcattaacagatacatctaagttactacttagtaatcaagaaagaagtttgaaggattgggttcttggtatcgacgatccactcgcaattaacgggtggcatgagttaactgattattgtttatcccccgttgatgcgccggttccttttgtaaagatgcacgggaaaaccatgtgggagtttgctgcagatatccctgaagttaatgagctaatcaataactccatggcttgtgatactaaattagtaatgcctgcatttttgcaaggttgccgtggtatcttgaataaaggtattgttaagaagatggttgacatcggtggtggtacaggtgctgctatgagttatgttgttaaggcttttcctgacataaaatgtatggtttttgatttgcctcatgttgttgctaacgcaccggagattgaaggtgtggaattggttggtggtgatatgtttgaattcatccctcctgctgatgctcttttgttgaagttcattctccataactgggatgatgtcggatgcatacagctactaaagaagtgcaaggagacaatttcagctgagcatgggaaagttatcataatagaaatggttttggaagaagacgaccaagacaatgatgctttggcacaagcaagattaagtcttgatttagatatgatggtatgttcaggaggaagagaaaggacgaaagatgaatggagaattttagtggaagaggctggtttcagtaagattgaattcatttctatttttgccattcaatcagttattgttgcatatccataa

SEQ ID NO: 4 - DNA, 1425 bp, Papaver somniferum
atggcaacaatgtatagtgctgctgttgaagtgatctctaaggaaaccattaaacccacaactccaaccccatctcaacttaaaaacttcaatctgtcacttctcgatcaatgttttcctttatattattatgttccaatcattcttttctacccagccaccgccgctaatagtaccggtagcagtaaccatcatgatgatcttgacttgcttaagagttctctttccaaaacactagttcacttttatccaatggctggtaggatgatagacaatattctggtcgactgtcatgaccaagggattaacttttacaaagttaaaattagaggtaaaatgtgtgagttcatgtcgcaaccggatgtgccactaagccagcttcttccctctgaagttgtttccgcgagtgtccctaaggaagcactggtgatcgttcaagtgaacatgtttgactgtggtggaacagccatttgttcgagtgtatcacataagattgccgatgcagctacaatgagtacgttcattcgtagttgggcaagcaccactaaaacatctcgtagtgggggttcaactgctgccgttacagatcagaaattgattccttctttcgactcggcatctctattcccacctagtgaacgattgacatctccatcagggatgtcagagataccattttccagtaccccagaggatacagaagatgataaaactgtcagcaagagatttgtgttcgattttgcaaagataacatctgtacgtgaaaagttgcaagtattgatgcatgataactacaaaagccgcaggcaaacaagggttgaggtggttacttctctaatatggaagtccgtgatgaaatccactccagccggttttttaccagtggtacatcatgccgtgaaccttagaaagaaaatggacccaccattacaagatgtttcattcggaaatctatctgtaactgtttcggcgttcttaccagcaacaacaacgacaacaacaaatgcggtcaacaagacaatcaatagtacgagtagtgaatcacaagtggtacttcatgagttacatgattttatagctcagatgaggagtgaaatagataaggtcaagggtgataaaggtagcttggagaaagtcattcaaaattttgcttctggtcatgatgcttcaataaagaaaatcaatgatgttgaagtgataaacttttggataagtagctggtgcaggatgggattatacgagattgattttggttggggaaagccaatttgggtaacagttgatccaaatatcaagccgaacaagaattgttttttcatgaatgatacgaaatgtggtgaaggaatagaagtttgggcgagctttcttgaggatgatatggctaagttcgagcttcacctaagtgaaatccttgaattgatttga

SEQ ID NO: 5 - DNA, 936 bp, Papaver somniferum
atgcctgaaacatgtccaaatactgttacaaagaggaggtgtgcagttgttactggcggaaacaagggtatcggatttgagatttgtaagcaattatcttctaatggaatcatggttgttttaacttgtagagatgtaactaaaggtcatgaagctgttgaaaaactcaaaaattccaatcatgagaatgtggtttttcatcaacttgatgttacggatccaattgctactatgtcttctttagcggatttcattaaaacacacttcggaaagcttgatatcttggtaaacaatgctggggttgcaggtttttcagttgatgctgatcgttttaaggcaatgataagtgacattggagaggattcagaggagctcgtgaagatctacgaaaaaccagaagcccaagaattaatgtcagagacatatgaattagcagaagaatgtctcaaaataaattacaacggtgttaaatcggtaaccgaagttctaattcctttacttcaactatctgattcaccaagaattgttaatgtttcatcatccacgggaagcctcaagtatgtatccaatgaaacagctctagagatacttggagatggtgatgcattaacagaagagagaattgacatggtagtgaatatgcttcttaaggattttaaggaaaatttgatcgaaacaaatgggtggcctagtttcggagctgcatacacaacatcaaaagcatgtttgaatgcttacacaagggtgttagcaaacaaaattcccaaatttcaggtcaattgtgtttgtcctggtttggttaaaacagaaatgaactacggcattggaaattatactgccgaagaaggtgctgaacatgtagtcagaatagctcttttccccgacgatggaccttctggttttttctatgattgttcagaactatctgcattttga

SEQ ID NO: 6 - DNA, 483 bp, Papaver somniferum
atggctcctctcggtgtttcaggtttagtcgggaaactttcaactgaattggaggtcgattgcgatgctgaaaaatattataacatgtataagcacggagaagatgtaaaaaaggcagttcctcatctttgcgttgacgtcaaaattatcagtggagatccgaccagttcaggttgtatcaaggaatggaatgttaacattgatggtaagacgattcgctcggtagaggaaaccacacacgatgatgaaacgaaaacgttacgtcaccgtgtatttgaaggagacgtgatgaaggatttcaagaagtttgatacgataatggtagtcaatccaaagccggatggaaatggatgtgttgtgacaaggtcaattgagtatgagaaaaccaacgagaattctccaactccctttgattatctacaattcggccatcaggccattgaggacatgaacaagtacttacgcgattctgaaagtaactga

SEQ ID NO: 7 - DNA, 1164 bp, Papaver somniferum
atggttacttccgccatggatattgaaaaactagagattctaggaacaacccataatggcaattcaaacacccgtatagagaaaccaaagaaaaccaaaaactggttgctagtcattatcaattgtgctattgtttttgttggtgcaataggtagtcctctcttaatgagactatactatcttcatggtggcagtcatatatggcttagtagttttattgcatctgctggttttccaattctcataattcctctcatgtttctcttcattcggtcgagatcatccgccgataaaatttcttcatctttttggatggaacacaagctgtttctttggggtgccatacttggggttctgtatggccttgttactttcatgtacgcattgggtttatcttatcttccagtatcaacttcgacaattctctttgcaactcaactgtgtttcacagcaatttttgcatggttaattgtgaaacaaaaatttacagcatttattataaatgcagtgattgtaatgacactaggatcgatcttattgggtattaataccaatggtgatagaccaattggggtatcaaaaactcagtacttaatagggtttcttatgacgttagctgctgctgctctaactggcctcgggacgccttttgttgagctttctttcattaaagccaccaggaatattacttatccaactttgttacagtttcaagtcattctttgtctgtttggaacctgcctcaacgtcattgggatgctaataaataaggattttcaggctatacccagagaagcagacatgttcgagcttgggaaaagcaagtattatatgataatatgcttgactgcattgacatggcaattatcaggaattggactcgtaggcctaattttgtacacaaatgctcttttcaacggtatatacgtatccgttcttgttccgttcacagaagttgcagcggtcatatttttccatgagaagtttacgggattaaagggaatggcattggcattatgtctttggggtttctcttcctatttctatggagaatacaagatgatgaataaagtgggtgataatgaaacacatgagaaaatcgaggaagccgaaagcgagcccaaaagattagaggatcaacaagcaccatacagtactgtatga

SEQ ID NO: 8 - DNA, 588 bp, Papaver somniferum
atggcttctgtaaacagtttcacaacccagagatttcttccaatcacaaacccaataaccaacagagagtcaaaatcgctgaaattttctgtaaaaggtctctctggttcttcttcgcttcagaaaaatttccacaataaatcaacaaatttgataactcgtttaaagcaaaagaaaatagattgcgtggttgttaaatcatcagttacagatgtaaaaagtagtgattcgttagatcaaaaagaaggggttattatagctcatcaaattgaaattgaatatgaaaattcattgagtaataatgataatccagttggtgaattatctaatgaagggagagtattatcatttgaggttgctggagaattaaaggggatttcttcttcttctactactactacttcttcctcatttggcctcatctctattctcttcataaacacaaacgaaatcgaagatctatcgaaaaaatcaatcaataacatcagctcttctctattctcttcatcaacaccagctgaaacgaagattcatcagctcttctcgatgctcatcattaacaaaatccatcagcagatcagttcttga

SEQ ID NO: 9 - DNA, 1581 bp, Papaver somniferum
atgcgaaccgaatcaatcaaaacaaacagaccgatggatctacttctccagtacttgcaaccgatttccgttgcacttgttgtgattgcactggtttggaactatggaagaagaaaccccaccaaaaaactagcacctgaagcctcaggagggagacctataatgggtcacttgcatcttttcaacgacggtgagttaactcatcggaaactcggtgcaatggcggatacttatggtcctgttttcaatatccgattcggttcgcataaaacactagttgttagtgattgggaaattgttaaagaatgttttacgacgaatgacaagctcttctcgaatcggccgggtacgttaggtattaaactcatgttttacgacgccgattccgttggttatgcgccgtatggtgcttactggagagatttacgaaagatttctaccttaaaacttctctcgaatcatcgtatcgatacgataaaacatctgaggagttctgaagttgagtcgtgtttcgagtcgctttatagtcagtggggaaacggggaaaagagtggcgaattcgctccggtgagaatggatagttggttaggcgatttgacgtttaatgttgttgccagaattgttgcgggtaagaagaatttctcggccaacggtgacgttggggctcagagatataaagcagcaatggatgaagctatgagattaatgagatttttcgcattttcggatgtaattccctcgctaagctggttagacaatctaagaggtttggtgcgagaaatgaaaaaatgtgcatctgaaattgattcaattatggctacttgggttgaagaacatcgcgtgaaaagaaattcaggaggtaattctcaactcgaacatgattttattgatgtttgcttggatattatggagcattcttcgttacccggcgatgatcccgacctcgtcgtcaaatctacgtgtctggacatgatattgggtgggagtgacacgacgacagttaccctaacatgggctatgtctttactcttgaaccatccccaagtactgcaaaaagcaaaagaagaactagagacacaagtaggaaagaaccggcaagtcgacgactcggacatcccgaatctcccattcatccaagcgatcatcaaagagacgatgaggctgtacccggctggaccattgatcgagcggaggacgatggaggactgcgaagtagccgggtaccaagttccagccggcacgcgcttattggttaacgtctggaagatgcaaagagatgggaacgtatacaaaggcgatccgttggagtttagacccgacaggtttttaactagcaatgcggatgtggatctaaagggtcagcattatgaattgataccatttggagctggtagaaggatatgcccgggagtatcgtttgcggttcaattgatgcatttggttcttgcccgattacttcatgaattcgaaatcacgactgtggagccagaaaccaaggtggatatggctgaaagtggtggtttgctttgttataagataatgccattggaagtactgatcaaacctcgactcgagatatga

SEQ ID NO: 10 - DNA, 1080 bp, Papaver somniferum
ctagatgtctgccatctgtctattcccagcgttgtttaagaagttccccagaagtctttgatccaatatcatattgggtaccttgtctccgaaaaagatcttagaattgttggcaatggcttgaataaacttgagttcaaggaactcgggtgtcagcttcaatttgtttgcttcggcttctttaatcactttatagtagtcagcatcagctaagcttttctcacgggccaagtacatatgattgtcaatctcctcttgcttcatggcactagttttctcagtcaacatctgttccatgcggatcttgctaacctgcgaattcttctcagcgtctgctaaggcgatctttttctgtgtctccgcttctttttcagctaccttttgtttttcaacagcaattaagaccttggtgtgctcctcctccatttgctcaaagttgcgccttatagactgtgggatagtgggtttagtgacacgcacacttagaatttcaatgcctggggcatactgtgtgcagtcaccctgcagagcttctttcattctttcatcaatctgatcaaacttgtcaatgtaaacttgctgaagggattgggcactgcagaactgattgatctcgtggtgtatcttgtcataaatccatgttttgtcgtactgtaccccgtagttgagcagagtctcgtacacatagtccttacggagacgattgacaacctcgatcttttcaaagtggatcatcacaccaccttttgtaccacagggtatatccttgacctgatctgtctgcagcgtcacctggatgggctcaaactgagttatcaatggcatctttacatgaaaacctggatctgtaattgttttgagaagggcaccccctctccagtacacaccaacatgaccttccgggacttgatgtaaactggagaaagtgctgtttgatgctgacaatgatgctggaatcaatatcagagcagcgattgcgacgagagcaattagaacagtgagaatgaaagatgcatctccaggatcggcaccaccgccttgaggaggtcgaggtgctcctcctggtctctgagaatccat

SEQ ID NO: 11 - DNA, 1911 bp, Papaver somniferum
atggaagctctgcaaatctcgtgtactgttgttacttgtaaatcatcaccaacaacaacagcattcaaacccagaagtaccacttcactaaaaaaatcaaacatttttggtattactaatagtagtagtgggattttattgtcactgaaaacctcaattacagacagagaaatcagatttcgatgttatcaagatgggttttcaatttctgatgcagaagaaattgatgcaaaagataaagacggcatttttatgacttacaagaaaaaaactgatcctggggtttctaaaattggtgaagtgattgctgagtctgtggctgatgttggtgaagctattgaagaagtggtgaaaccaaaagcagcaggagagacatacagcattgttgttgtatcatcagaggcggtgccgtattctaaaacaggaggtttaggagatgtttgtggttcattacctattgcgcttgctgcgcggggacatcgagtcatggtagtgtctccaagatatgtgaatggtagtgcttccgataagatttataaaggtgcacttgatgcgcaatgtaggattaagattccgtgctttgaagctgagcatgaggttgcattcttccacgagtatagggcgggtgttgattgggtgtttgttgatcacccttcttaccatagacctggaaatccttatggggatcaatttggtgcttatggtgataatcagtttaggttcacgctactgagccatgctgcatgtgaggctccgttggtacttccactcggaggcttcacatacggggaaaagtgtatgttcctcgttaatgattggcatgcaagtcttgtaccagtcctcttggcatctaaatatcgcccatatggagtttataaggatgctcgcagtattcttgctatacataaccttgcacatcagggtgtggaaccagctgcaacttacaagaattttgggttgccagctgagtggcatggagcattagaatgggtatttcctacatgggcaagaactcatgctcttgacacaggggaagctgtcaatattatgaagggtgcaattgttacagccgaccggattctaacagtgagcaagggttatgcatgggaaataacaactgttgaaggtggatatgggcttgacggactcataagcagccgagagagcgttctggatggaatcactaatgggattgacattgatgagtggaatccatcttcagatgtacacattcctttccattactcaattgatgacttatctgggaagcaagaatgcaaggcggcgttacaaaaggaactggggttgccagtcaggcctgatgtcccattgattgggttcatcgggagactagactatcaaaaagggatagatatgattgaagcagcaatgccagagcttatgatggacgatgttcagtttattatgctcgggtctggcaatgcacgtatggaagactggatgaaggcaacagaggcagcttataaggacaaataccggggttgggttggatttaatgtacctatttctcacagaataactgcaggagctgacatattgttgatgccgtcaagatttgaaccttgtggtctaaaccagttgtatgctatgagatacggaactatacctgtggtgcattgcactggaggactaagggacacggtggaaaacttcgacccttttgctaatgaaggcagcggtaaaggaacaggatggactttttcaccattagcgaaggaccctatgttgggggtgttgagaattgcgatggacacgtataggaaacataaagattcgtggaagggattgatgaagagaggaatggaacaggactttacatgggacaaagctgctgctcagtatgaacaagtttttaaatgggctttcatggatcctccttatgttaaatga

SEQ ID NO: 12 - DNA, 1596 bp, Papaver somniferum
ctgcttcggcggcttcttgtaacaggtaggattcgtacatgtttgcttgttatgatgaccaagctcaaaacaattaccacagcgcatagctctcctgggcggcttctcatatctgctcaaatgcctattagcttgtggtctccctggcggcctcctaacatcaggtacatcgataatatcattaccttcataaacttcaggcctgttatagttcggaataggatgaattgcatgactgtaggcattattgaagtatgaagtagtgaaataaggttcaacaaaatcatatggattagaaccagacattgttatcgatgcgaaagcatgcacacatggaaacccatagacgcgccacctctgacaggtacatgtccttgcctcaaggttaacactatgagaactgtcccctccttccacttcataaacatgagtatcggactgtataaccagccaggttaaacccccatcaataagagccttcatcttattttcattcttcggtgtgagaattgttatgaaactattacccgtattccgcctttctgacatcatactcatcacatccttccttatctgatccagaagagcatttgcagggagcttcttgtgtaccttcatccaactattgaaggattcagcaagagtagaagatgtcctaccatacctacaaccctggaaaaaggcatttgaccacttctctggagggatatcttcaatatagtcggcaacccaaccacaaccaagacccctaatagtagcgatggcagtttggaaaccttcgcgactaagagcataagcaacagcttgaaatgaatcaataactgcaccatacctttcgtcagatgcattaataggtaagttcatcttaagatgataatagcagaaactatggaaggctccaggaaagtaaaatggaatcgctctctttaatccttctgcacgatcagataaaaatgtgattggcctttgatcatgatcaagaacattactcaaattcctcatgaaccattcccagttatcattatcttcaccaggtaccagggccatggctagtgggaagaagccattttcagcattgatagcggttgcagccatgaggcatcctctatatgtccctgtaagaaaggtagcatcgacataaaccatggggcgaaggtaacggtaaccatggatgcatgcctcgaaagcaataaaaagacgcacaaacttatttgaaggtgcctcatcttctaattcagctgaactatcctcgttcgcttcaggttcatccgtttgaacttgaaaatcaatccaactcccaggatttgtgctgcgaatggaatctacataccatgaaagatgcgaatacgacatggcttcatcaccaaatatatcctcatacactttctctcttccgttgtaagcttggtagtatttcacattgatcccgtagctagttttgaaaaactttgccaaatcagatgctttgaaactcggatcacttcggatttcatccttgatcaaagtagaaacaaatttactgctgagcctgtggaaaagcctttgacatcccacaccacagtgatgactgctataatatttcttaaccttaagcat

SEQ ID NO: 13 - DNA, 1419 bp, Papaver somniferum
atgatgggaatgtcgaagaaaaagaagacggcaaagaactggttcacctctgtcaagaatgccttcaagtcctcagcaccaatatcatcatctccttcatccaaggattactctttagccaataagataatagaggagggacacgagataccggagattgtgtcgcttgaacattatccggtttgcgatacttcgtctctgacgacgacaatagatgaaaataatgctgaagcagtactagagatgagagatgaagatcgtagacgaagtaatcatgcgatcgcaatggcagttgttgcagcagaagcggcggttttagctgcccatgaggctacaaaggtgtctaggttttctagttataatcgtcgcaggttttatggttactctaaagaagaaagagctgccaccaaaatacaatcccattacaaaggatacttggcacgaagagctttgagagcactgagaggactagtgaagctacaagcactagtaagagggcacaatgttaggaaacaagctgagatgacaatgcgatgtatgcaagcgatcgttcgagtgcaggcaagaacaaaagcagatcgcctccgtttacagggtgcaacttctcgcgacaacgagaaaaacaaaggtaaaaagagagcaacggagacgtggaataatagcaggggaaggcagcagcaggcgcgcaatagtttcagctttgagaatgaatacgcgtctcagaagatcaacaaacaagaacattatctttcgagtaattcaatgacaattcaaaatgaaagagcccttgcatatgcttatccctaccaggactcggtgtcaaaccgtcagaactcggttgattcatattcggatgaaaaaacaaaccaaggtggctggaacttgttggatcgttggattgattcgcaaccatggcatcgtgataaacatgtcgcagcaataccggagagctcttacaccagccgtacgtataacaccgacgatgataatgcgtctgaaagaacggcagatacggacttggtatcattatcaccaagttatcagctccggtttaacccaatttctaacctgtcaaagctcggtataaactcggctggctcggtcccgatacgccagcggaaacaaagagttatggtttcggtggaaacagaaaatgtgaatacaccgagttacatggctacgactcagtcagcaaaagcaaaggcaaaatcggcacagaattctttattaagctcttcatcatcaactaggaggatatttttgaacgatttgtcaatgagttcaagcactgatggaatcggaaccggagaagtgaggacaatgaaccaactaggtccaattaatagcccaagtccaacaagtagtcaaaagatgatgcgtttgttgaagatgggaaagcccattaaaggagtaagatag

SEQ ID NO: 14 - DNA, 1413 bp, Papaver somniferum
atggatactttccaattccctaaactcctgaaaaattccattctcatcatatttttcctgcaaatctcattctctctatcatggggtttcttcatccctgtggataattacctagttcattgcggatcggttgaaaacacagtcctcaacaatcgaatcttcgttagcgattcgtctggttgtggatcgagtttatggtctgcagctaggacaacctctctcaaagatgaaaacccacttgaaggttcatctcctctttatcatacagccagggttttcacaaaactatcaaattatgagtttgaaatcaaagaaaagggaactcatttcgtacgtcttcatttctttccttttgattcaacgaaacttaatctctcggattctctttttcatgtttctgttaatggggttttgcttttgagcaattttaccggtcaagaggaggagagtcgtaatttcaaaaatcctgttttgaaagaatatctaatatgggttgaaagtggtgataagcttgtactttcattcattccttcaaaagaatcatcttttgcatttgtgaatgccattgaggttatttctgcacctaaagatctcatagctgatactgcacaacatgttacctctgaaagagttgagaaatataatggattgactaaagaggcgttagagacgatttacagaattaatattggaggtccaaaggttacaccttttaacgatactttatggagaacttggatacctgctgatgggttcttaaaattagttgctgcttcaaaggcaatttcatttagtggcaggatcaaatatcatgctggaggagccagccgagaagttgctcctgataatgtttacagttctgccagaataatgagttaccctaatgtttcaatgccagattttaacataacatgggttttccctgttaagtcaggctatagttaccttgctcggatgcatttttgtgatattgctagtatggctcttaatgagctctatttcgatatttacataaatgggtatgctgcctacaaagattttgacatgtcagagctttcaggccagatgcttgctgctccttattacgctgattttgtaatcgatgctcatactgccaaggagttgacgattagcattggcccgtcaagtcttagcagtccagaaagaattaatgcgatactgaatgggttagagatcatgaagatgaataattctatgggtagtcttgatggagaaatctcagtggattctattatgcagagttcaccaagaaggcatatggggatttcagcgccctcagttgttgttttaagtttattgcttgctgcatttgttctgcataagaggaggactgggaagaaagactccatggggtggtcaccgttgcctgtggatgttccagaaggcaaatag

SEQ ID NO: 15 - DNA, 726 bp, Papaver somniferum
atgttgaccggggagagttctttacctaatgtaggtctttatcgcacgaccatagaggaatctaatgagatcaagaaacaagtccaggaacttctagaattaggaatgatagtgccaagtgcttcaccttatggatcagcggtgttgctggtgccaaagaaagatggaggctggcgtatgtgtattgattatagagcattgaacaagatcacaatcaagaatcgttaccctttacctaggatagacgacatgatggatcagttggaaaaagttcgagtctttacaaagttggatttcaaattccgataccaccatatgagagttcaagaagatgacacatggaagactgctttcaaaaccaaacaaggcttgttcgaatggttggtgatgccttttggtttgtgtaatgcttcagcgacatttatgtgtttgatgaatgatttgatacgaccttttatagaatattttgcgattgtttatttggatgatatccttatatacgacagaacttgggaagagcatcttgttcatgctgagaaggtgtttaaagtattacatgaaggccagctgaagttgaacgtaaaaatgtgtgagtttgggaaggaggagttagtgtaccttggattcattgttggcggtggacaacgaaaaattgatccaaagaaggttgaagtgatcactaagtgggctagacctagtactgtaactgaaatcaggagttcttag

SEQ ID NO: 16 - DNA, 747 bp, Papaver somniferum
atggcaattgtatgcatgacctatgagggtgttaaatctatcgaatcatatgaaaaggaaggaaaaatcagtaagggttctggtatacatggtcttggagcatcgattgcaaaacccgtggacggaagatttgaagtcatctgtcttgaaggtttaagaccctacgtcggtgatatagtttctgatgacccacaacggaagcttgcccttatgaaaccaagattaccaaatggcgagtgtccgcctggatttcttggctttgctgtaaatatgatcaatttggaccattcatacttgtcttatgtaacagccactggacatggtcttcgagagaccttattctatagccttttctctcgcctccaagtgtatagaactcgagcagagatgttacttgcccttccttttatatgtgatggagccatgtctctggatggtgggatgattaggagtgctggtatgttggtccttggtgataggaaagacgtggaggttagatttcctcttacttctccaacgaagaaaatggctttaaactacttggatactgaagaaaagttgaagctgaagaaatgggaaaaggaaaggattttggatgatgttcaaagagaacaacagttactgttccacgtgaaacaaagttttgaatctaaaaggcaagaatttgttaagaatcttgctgaaagctcatcctacataactcagcagcaattccagtcaggaagtagaagcagcaccccaagatga

SEQ ID NO: 17 - DNA, 384 bp, Papaver somniferum
atgtctgccaaagaaataagagtgacacaaccaatgttgcagggctacttcaacccctccctatatatcccagaccagccatggaaacatatcactatgggcttcatagaaggcttaactgtcagcaataaaaagattgtaattcctgtcattgtggacagactcaccaagtatgctcatttttttgctcttcaacacccctacacagcagcttcagtttctcataccttcctcaatgaagtgttcaaattacatggcttaccttcatccattgtatctgacagagacaaggtcttcacaagaaagttttggcaggatctatttaaggccttgggcactaatctcaacctcagcactgcatatcatccccaaacagatggctag

SEQ ID NO: 18 - DNA, 2811 bp, Papaver somniferum
atggtatatgctagtgccgatcactttcaaattaaaatgtgggtttctgtgtcccgaaaatcaaacaacagggagatatttggggacctcttggaacccaatgtaaaccgccaatcaagcttgaatgtcattcaagattgccttaaagagaaacttatggtggggaaatgcctgatagtactcgatgatgtgtggattaatcatggcatcgacgtagatgagttactgaaagatctcttatctatgagtttccaaggaagtaaaattcttatgactatgaggagtgctgaagatattcctccgatgaaggatcatcgatacatcatctaccaattacaaggtttacctgaagatgattgttggtctataattaaggacatcgcatttggacatggaggtgcgaaggagactccaaatctaatcaacacggggaagcaaattgcaataaaatgtggaggtcttcctctggctgcaaagactctcgggggtttgctctactctagaaatgatcaagaagaatggttatctaacttgaacacccaaagttgggaactcccaacaggcgaaagtaagatcgtctctctattgaagttcagttatgatcatttgtcaccatatgtgaaatgcttttcatattgttcgatttttccaaagggtcatgtgttttcgaagaatgaagttatcagaatgtggatggcagagggattccttattagtccctggcaagcaaatgagtctccggaaattgtaggtaacggatatttcaagattttgttgctcaactcttttttccaggatgagcgcagaaacatttggggggacatcaagtcattcagaatgcacgatcttgtccacgatctttcagtatcaattacagggtgtgagtctcttaatataacaatagatgatattccaaagattgatcaatcttttacgtttcgtcgcttagggttacaagtccttcattctggtgtctcaacagcaattccgtcagagatttataaagccttcaaaaaactacacacttttgtttattctggactccatgatggtgaagatgtctgggcaaggcgcgtctgcaccttcggtttcataagggttttaaaattaagtcacacgggaattgaagagttgcctaaatcaatttgcaaattaaagcatcttcggtatcttgatgtcaaaagatgtaatagattgaaagagcttccccaagacatcagaaagctgatcgggttggaatatctcatattcagaaataagtatacgttgagtgctaaaatgccaagaaaggtaagcagattgagtgcacttaaaaagttatctgtatttatcgtgggagaagaaggcaaaggttctggtatagaagaattgaaagatctaaatcttcttggaggtaaactcagtatcgaagatttgggaaacgtaacagatggcacgcaagcaaatttaatggggaagaaaaatattagacacctagaactgagttgggattcacggggttgtaatgatcctgatagaattatcaaagatgttgaggtgattaatgacctccaacctcacctaaatctgaaaaagttgggagtttcacattttggtggttcagagatccctacatggttgaggagtgcttccgtacatcttccaaagttggtatctatcactctgtatcggtgtaatgagtgtgaacactttcctgcacttggaggactacagcatcttaaatatctttttatggatggatttggaggtgtcaaaagaatcggtaatgagttctgtccaagtaatgaagaagcagtatcattcccttctttggtactactttatatttatcattacacaaattcggtgaactctgatcggagtagtcgagcatctactttctcttggtctgaagatttggagaatcaaaatggttcaacgctgtcaaccacgccaacagagtttccatttcttagaaagttatattttcatattgagcggcaagtggatgccaacctcaagtctctatctccaaaactgctttggggggttctccagactttactggtcgctgggtgtaatgagttcgtgggctttgagcagcaacatcgtcatcaactagatcatctttcttacagccatcttcgtaggctagaagtttttaaatgcccttctttaacggtattgcctgcagacttcagcggattaaattctctgacctatttagctattgaagagtgcagtagtcttcactcattgccagatggaatacagtacctcccggcacttgagacactcataatcggtggcttttcagaagacttaacatcttttccatttccagcggcaagcggatctgatggtgaaaaatacttcgtttccctccgtgtattaaagatatgcgggtggcctactctaagtgccgagttgccggaccaacttcaactcctcacttgtttacagtgtttcactataagaggttttccttgtctatcgagtttgcctgagtggtttcgagaattatcttccctccagaatttgtactttctaaattgcagcaggctgcagtatcttccttctgacgaacagatgcaacgcctaacgtccctgaaaaccatatacatttggaattgtccactgttgcttgaaagatgttctggcaatgaagaagggcataagattgcacgccgcaaacaaggtttttctcgtctctcttttcctcgttttaatattttactaccggagacagagccggtcctgagtctagaagggccctgtgcgaaaaaatttcgcagggccttttataaggttaacgcaaatgataactcttaa

SEQ ID NO: 19 - DNA, 456 bp, Papaver somniferum
atgactgaatccaaaatcagaaaattagctggagaaaaacttgggtttgatttatcaggtaaacaagagaagaaatttattagggaaattgttaatgaatttcttgttcagaaagaagaagaagttcaagaaaaaggaaaacaacaagtagaagatgaagaagaaaaggaggaagaagaagaagagaagaaaaggaaaaggccaggggtttctgttaaagaatatgaagataatggtgatcttattatttgtcagctatcaagtcgaaggaaggtgacaattcaagagtttaaagggaaggcattggtatcaataagggaatactatgaaaaagatggaaaggagcttccttctactaaaggaataagcttgacagcggaacaatggtttactttcagtaaatctgtccctgggattgagcaagccattaagaagatgcagacaaggtctcggtga

SEQ ID NO: 20 - DNA, 858 bp, Papaver somniferum
atggatgatcataccaaacccttcattctcacttcaatttcattccaagtgatagcgtgttttttcacgattttttgcattttgtttgggtttttctggtttaacaaggagaagacgaagaagaaaaagtgttgtgattgtgattgtagtaagaagattagtgaagaagaagaggggtataaagggtatttgaacggaggaggggagatgccagttagggttacagaaggtggaggaggaggagggagtgtttcgatgatggaacagttggtgccagagattacaactcatgctttgagttatttggattatccgagtttgtgtaggctttctatgactaattcttctatgagaaaagctgctaatgatgatagtgcttggaaaatgctctaccacaaggacttcacagcggaacaggacagcgtgatgccagtaaatggctggaaggcatactatgctgctactagagcaataatgaacatcaatgctgagttcttcaacatcataagagatagatcggttccagggatgggtgctttttggctgaatgcagattatgtaaagtgtattcatacatcaggagaagttttctcagggtatgacgctgttatggaaagctggcaacttacattcaactggggccaaggggttgccttccagatcagggatgtgaagacacgcgtattcacagacatagcttgggttaccatgaaaacttatgttgacgatcctaatagtgggccattcaatgtgaccaatgtttacgagtttcacaaagggcagtggtacttggttcaccatcactgctctgtgatactaattggcgcagaggctgatcagcaaaacgtatttggatag

SEQ ID NO: 21 - DNA, 426 bp, Papaver somniferum
atgtgtcacttattaagttctgagactaagcctaagtactttaggaaattagaatcgacacatttgcttcagaatgaccactactctgactgtggtcaactttgtaagtcatacctaattgacttagaggatcctaaattatttaggttattttgtgactccaggttcttatctgagtttttccagactctaggacctaataatttggatcctacctatgaggaaatgcatccgaggaaaatagtctatttagaccccttcatagaacctgaacctgaaccgcaattagcgatagttatccagaaactaggtaagggcatgctagtcttgtacattttcttggttcactgcaatttccttttgtcagctctttttggttttaaagacccacagttattccggctactgttatacggttcgagttga

SEQ ID NO: 22 - DNA, 546 bp, Papaver somniferum
atggcaacaatattggtaggctggtccgctccaaataccaactggatcaaaattaacacagatggagcagccagaggccacccaggatttgcaggggtgggtttcgtctgcagagactctgatgcacgaacaataatagctttggcacaaccattaggaattactactgcactaactgcagaaacatgggccttcctattggcttcaagaacaacaacagagagacaatggcctagaattctctttgaaacagactcggagaacctcatgcgtctcatcacaacaactacaacaccaccgtggtacatagcagaaatgattaaagaaataaaaaacagattgaggcaaattccgcaagtcgttgtacaacacaactacagagaaggaaatcaagcagcggacggactggcaaaccatgcaacggatggaagtcaaacaggaaactactcaaccaaaatctgggaccaggcaatttcatcttttattagtcacattttatttcaagattacgtgggtaccaaatacccaagacaagctgtaaactaa

SEQ ID NO: 23 - DNA, 2811 bp, Papaver somniferum; identical to SEQ ID NO: 18

SEQ ID NO: 24 - protein, 900 aa, Papaver somniferum
MELQYISYFQPTSSVVALLLALVSILSSVVVLRKTFLNNYSSSPASSTKTAVLSHQRQQSCALPISGLLHIFMNKNGLIHVTLGNMADKYGPIFSFPTGSHRTLVVSSWEMVKECFTGNNDTAFSNRPIPLAFKTIFYACGGIDSYGLSSVPYGKYWRELRKVCVHNLLSNQQLLKFRHLIISQVDTSFNKLYELCKNSEDNQGNYPTTTTAAGMVRIDDWLAELSFNVIGRIVCGFQSGPKTGAPSRVEQFKEAINEASYFMSTSPVSDNVPMLGWIDQLTGLTRNMKHCGKKLDLVVESIINDHRQKRRFSRTKGGDEKDDEQDDFIDICLSIMEQPQLPGNNNPSQIPIKSIVLDMIGGGTDTTKLTTIWTLSLLLNNPHVLDKAKQEVDAHFRTKRRSTNDAAAAVVDFDDIRNLVYIQAIIKESMRLYPASPVVERLSGEDCVVGGFHVPAGTRLWANVWKMQRDPKVWDDPLVFRPDRFLSDEQKMVDVRGQNYELLPFGAGRRVCPGVSFSLDLMQLVLTRLILEFEMKSPSGKVDMTATPGLMSYKVIPLDILLTHRRIKPCVQSAASERDMESSGVPVITLGSGKVMPVLGMGTFEKVGKGSERERLAILKAIEVGYRYFDTAAAYETEEVLGEAIAEALQLGLVKSRDELFISSMLWCTDAHADRVLLALQNSLRNLKLEYVDLYMLPFPASLKPGKITMDIPEEDICRMDYRSVWAAMEECQNLGFTKSIGVSNFSCKKLQELMATANIPPAVNQVEMSPAFQQKKLREYCNANNILVSAISVLGSNGTPWGSNAVLGSEVLKKIAMAKGKSVAQVSMRWVYEQGASLVVKSFSEERLRENLNIFDWELTKEDHEKIGEIPQCRILSAYFLVSPNGPFKSQEELWDDEA

SEQ ID NO: 25 - protein, 505 aa, Papaver somniferum
MAPINIEGNDFWMIACTVIIVFALVKFMFSKISFYQSANTTEWPAGPKTLPIIGNLHQLGGGVPLQVALANLAKVYGGAFTIWIGSWVPMIVISDIDNAREVLVNKSADYSARDVPDILKIITANGKNIADCDSGPFWHNLKKGLQSCINPSNVMSLSRLQEKDMQNLIKSMQERASQHNGIIKPLDHAKEASMRLLSRVIFGHDFSNEDLVIGVKDALDEMVRISGLASLADAFKIAKYLPSQRKNIRDMYATRDRVYNLIQPHIVPNLPANSFLYFLTSQDYSDEIIYSMVLEIFGLGVDSTAATAVWALSFLVGEQEIQEKLYREINNRTGGQRPVKVVDLKELPYLQAVMKETLRMKPIAPLAVPHVAAKDTTFKGRRIVKGTKVMVNLYAIHHDPNVFPAPYKFMPERFLKDVNSDGRFGDINTMESSLIPFGAGMRICGGVELAKQMVAFALASMVNEFKWDCVSEGKLPDLSEAISFILYMKNPLEAKITPRTKPFRQ

SEQ ID NO: 26 - protein, 358 aa, Papaver somniferum
MDIKLEDEEQEIKYQGHVWNMICGSVNSSVLKCTIVLGLFDTIHNSSKPMTLSSLSSASPSLSPLKTENLYRLLRYLSHMNLIVINSIQGSDDTFSLTDTSKLLLSNQERSLKDWVLGIDDPLAINGWHELTDYCLSPVDAPVPFVKMHGKTMWEFAADIPEVNELINNSMACDTKLVMPAFLQGCRGILNKGIVKKMVDIGGGTGAAMSYVVKAFPDIKCMVFDLPHVVANAPEIEGVELVGGDMFEFIPPADALLLKFILHNWDDVGCIQLLKKCKETISAEHGKVIIIEMVLEEDDQDNDALAQARLSLDLDMMVCSGGRERTKDEWRILVEEAGFSKIEFISIFAIQSVIVAYP

SEQ ID NO: 27 - protein, 474 aa, Papaver somniferum
MATMYSAAVEVISKETIKPTTPTPSQLKNFNLSLLDQCFPLYYYVPIILFYPATAANSTGSSNHHDDLDLLKSSLSKTLVHFYPMAGRMIDNILVDCHDQGINFYKVKIRGKMCEFMSQPDVPLSQLLPSEVVSASVPKEALVIVQVNMFDCGGTAICSSVSHKIADAATMSTFIRSWASTTKTSRSGGSTAAVTDQKLIPSFDSASLFPPSERLTSPSGMSEIPFSSTPEDTEDDKTVSKRFVFDFAKITSVREKLQVLMHDNYKSRRQTRVEVVTSLIWKSVMKSTPAGFLPVVHHAVNLRKKMDPPLQDVSFGNLSVTVSAFLPATTTTTTNAVNKTINSTSSESQVVLHELHDFIAQMRSEIDKVKGDKGSLEKVIQNFASGHDASIKKINDVEVINFWISSWCRMGLYEIDFGWGKPIWVTVDPNIKPNKNCFFMNDTKCGEGIEVWASFLEDDMAKFELHLSEILELI

SEQ ID NO: 28 - protein, 474 aa, Papaver somniferum; identical to SEQ ID NO: 27

SEQ ID NO: 29 - protein, 160 aa, Papaver somniferum
MAPLGVSGLVGKLSTELEVDCDAEKYYNMYKHGEDVKKAVPHLCVDVKIISGDPTSSGCIKEWNVNIDGKTIRSVEETTHDDETKTLRHRVFEGDVMKDFKKFDTIMVVNPKPDGNGCVVTRSIEYEKTNENSPTPFDYLQFGHQAIEDMNKYLRDSESN

SEQ ID NO: 30 - protein, 387 aa, Papaver somniferum
MVTSAMDIEKLEILGTTHNGNSNTRIEKPKKTKNWLLVIINCAIVFVGAIGSPLLMRLYYLHGGSHIWLSSFIASAGFPILIIPLMFLFIRSRSSADKISSSFWMEHKLFLWGAILGVLYGLVTFMYALGLSYLPVSTSTILFATQLCFTAIFAWLIVKQKFTAFIINAVIVMTLGSILLGINTNGDRPIGVSKTQYLIGFLMTLAAAALTGLGTPFVELSFIKATRNITYPTLLQFQVILCLFGTCLNVIGMLINKDFQAIPREADMFELGKSKYYMIICLTALTWQLSGIGLVGLILYTNALFNGIYVSVLVPFTEVAAVIFFHEKFTGLKGMALALCLWGFSSYFYGEYKMMNKVGDNETHEKIEEAESEPKRLEDQQAPYSTV

SEQ ID NO: 31 - protein, 195 aa, Papaver somniferum
MASVNSFTTQRFLPITNPITNRESKSLKFSVKGLSGSSSLQKNFHNKSTNLITRLKQKKIDCVVVKSSVTDVKSSDSLDQKEGVIIAHQIEIEYENSLSNNDNPVGELSNEGRVLSFEVAGELKGISSSSTTTTSSSFGLISILFINTNEIEDLSKKSINNISSSLFSSSTPAETKIHQLFSMLIINKIHQQISS

SEQ ID NO: 32 - protein, 526 aa, Papaver somniferum
MRTESIKTNRPMDLLLQYLQPISVALVVIALVWNYGRRNPTKKLAPEASGGRPIMGHLHLFNDGELTHRKLGAMADTYGPVFNIRFGSHKTLVVSDWEIVKECFTTNDKLFSNRPGTLGIKLMFYDADSVGYAPYGAYWRDLRKISTLKLLSNHRIDTIKHLRSSEVESCFESLYSQWGNGEKSGEFAPVRMDSWLGDLTFNVVARIVAGKKNFSANGDVGAQRYKAAMDEAMRLMRFFAFSDVIPSLSWLDNLRGLVREMKKCASEIDSIMATWVEEHRVKRNSGGNSQLEHDFIDVCLDIMEHSSLPGDDPDLVVKSTCLDMILGGSDTTTVTLTWAMSLLLNHPQVLQKAKEELETQVGKNRQVDDSDIPNLPFIQAIIKETMRLYPAGPLIERRTMEDCEVAGYQVPAGTRLLVNVWKMQRDGNVYKGDPLEFRPDRFLTSNADVDLKGQHYELIPFGAGRRICPGVSFAVQLMHLVLARLLHEFEITTVEPETKVDMAESGGLLCYKIMPLEVLIKPRLEI

SEQ ID NO: 33 - protein, 359 aa, Papaver somniferum
MDSQRPGGAPRPPQGGGADPGDASFILTVLIALVAIAALILIPASLSASNSTFSSLHQVPEGHVGVYWRGGALLKTITDPGFHVKMPLITQFEPIQVTLQTDQVKDIPCGTKGGVMIHFEKIEVVNRLRKDYVYETLLNYGVQYDKTWIYDKIHHEINQFCSAQSLQQVYIDKFDQIDERMKEALQGDCTQYAPGIEILSVRVTKPTIPQSIRRNFEQMEEEHTKVLIAVEKQKVAEKEAETQKKIALADAEKNSQVSKIRMEQMLTEKTSAMKQEEIDNHMYLAREKSLADADYYKVIKEAEANKLKLTPEFLELKFIQAIANNSKIFFGDKVPNMILDQRLLGNFLNNAGNRQMADI

SEQ ID NO: 34 - protein, 636 aa, Papaver somniferum
MEALQISCTVVTCKSSPTTTAFKPRSTTSLKKSNIFGITNSSSGILLSLKTSITDREIRFRCYQDGFSISDAEEIDAKDKDGIFMTYKKKTDPGVSKIGEVIAESVADVGEAIEEVVKPKAAGETYSIVVVSSEAVPYSKTGGLGDVCGSLPIALAARGHRVMVVSPRYVNGSASDKIYKGALDAQCRIKIPCFEAEHEVAFFHEYRAGVDWVFVDHPSYHRPGNPYGDQFGAYGDNQFRFTLLSHAACEAPLVLPLGGFTYGEKCMFLVNDWHASLVPVLLASKYRPYGVYKDARSILAIHNLAHQGVEPAATYKNFGLPAEWHGALEWVFPTWARTHALDTGEAVNIMKGAIVTADRILTVSKGYAWEITTVEGGYGLDGLISSRESVLDGITNGIDIDEWNPSSDVHIPFHYSIDDLSGKQECKAALQKELGLPVRPDVPLIGFIGRLDYQKGIDMIEAAMPELMMDDVQFIMLGSGNARMEDWMKATEAAYKDKYRGWVGFNVPISHRITAGADILLMPSRFEPCGLNQLYAMRYGTIPVVHCTGGLRDTVENFDPFANEGSGKGTGWTFSPLAKDPMLGVLRIAMDTYRKHKDSWKGLMKRGMEQDFTWDKAAAQYEQVFKWAFMDPPYVK

SEQ ID NO: 35 - protein, 532 aa, Papaver somniferum
MLKVKKYYSSHHCGVGCQRLFHRLSSKFVSTLIKDEIRSDPSFKASDLAKFFKTSYGINVKYYQAYNGREKVYEDIFGDEAMSYSHLSWYVDSIRSTNPGSWIDFQVQTDEPEANEDSSAELEDEAPSNKFVRLFIAFEACIHGYRYLRPMVYVDATFLTGTYRGCLMAATAINAENGFFPLAMALVPGEDNDNWEWFMRNLSNVLDHDQRPITFLSDRAEGLKRAIPFYFPGAFHSFCYYHLKMNLPINASDERYGAVIDSFQAVAYALSREGFQTAIATIRGLGCGWVADYIEDIPPEKWSNAFFQGCRYGRTSSTLAESFNSWMKVHKKLPANALLDQIRKDVMSMMSERRNTGNSFITILTPKNENKMKALIDGGLTWLVIQSDTHVYEVEGGDSSHSVNLEARTCTCQRWRVYGFPCVHAFASITMSGSNPYDFVEPYFTTSYFNNAYSHAIHPIPNYNRPEVYEGNDIIDVPDVRRPPGRPQANRHLSRYEKPPRRAMRCGNCFELGHHNKQTCTNPTCYKKPPKQ

SEQ ID NO: 36 - protein, 472 aa, Papaver somniferum
MMGMSKKKKTAKNWFTSVKNAFKSSAPISSSPSSKDYSLANKIIEEGHEIPEIVSLEHYPVCDTSSLTTTIDENNAEAVLEMRDEDRRRSNHAIAMAVVAAEAAVLAAHEATKVSRFSSYNRRRFYGYSKEERAATKIQSHYKGYLARRALRALRGLVKLQALVRGHNVRKQAEMTMRCMQAIVRVQARTKADRLRLQGATSRDNEKNKGKKRATETWNNSRGRQQQARNSFSFENEYASQKINKQEHYLSSNSMTIQNERALAYAYPYQDSVSNRQNSVDSYSDEKTNQGGWNLLDRWIDSQPWHRDKHVAAIPESSYTSRTYNTDDDNASERTADTDLVSLSPSYQLRFNPISNLSKLGINSAGSVPIRQRKQRVMVSVETENVNTPSYMATTQSAKAKAKSAQNSLLSSSSSTRRIFLNDLSMSSSTDGIGTGEVRTMNQLGPINSPSPTSSQKMMRLLKMGKPIKGVR

SEQ ID NO: 37 - protein, 470 aa, Papaver somniferum
MDTFQFPKLLKNSILIIFFLQISFSLSWGFFIPVDNYLVHCGSVENTVLNNRIFVSDSSGCGSSLWSAARTTSLKDENPLEGSSPLYHTARVFTKLSNYEFEIKEKGTHFVRLHFFPFDSTKLNLSDSLFHVSVNGVLLLSNFTGQEEESRNFKNPVLKEYLIWVESGDKLVLSFIPSKESSFAFVNAIEVISAPKDLIADTAQHVTSERVEKYNGLTKEALETIYRINIGGPKVTPFNDTLWRTWIPADGFLKLVAASKAISFSGRIKYHAGGASREVAPDNVYSSARIMSYPNVSMPDFNITWVFPVKSGYSYLARMHFCDIASMALNELYFDIYINGYAAYKDFDMSELSGQMLAAPYYADFVIDAHTAKELTISIGPSSLSSPERINAILNGLEIMKMNNSMGSLDGEISVDSIMQSSPRRHMGISAPSVVVLSLLLAAFVLHKRRTGKKDSMGWSPLPVDVPEGK

SEQ ID NO: 38 - protein, 241 aa, Papaver somniferum
MLTGESSLPNVGLYRTTIEESNEIKKQVQELLELGMIVPSASPYGSAVLLVPKKDGGWRMCIDYRALNKITIKNRYPLPRIDDMMDQLEKVRVFTKLDFKFRYHHMRVQEDDTWKTAFKTKQGLFEWLVMPFGLCNASATFMCLMNDLIRPFIEYFAIVYLDDILIYDRTWEEHLVHAEKVFKVLHEGQLKLNVKMCEFGKEELVYLGFIVGGGQRKIDPKKVEVITKWARPSTVTEIRSS

SEQ ID NO: 39 - protein, 248 aa, Papaver somniferum
MAIVCMTYEGVKSIESYEKEGKISKGSGIHGLGASIAKPVDGRFEVICLEGLRPYVGDIVSDDPQRKLALMKPRLPNGECPPGFLGFAVNMINLDHSYLSYVTATGHGLRETLFYSLFSRLQVYRTRAEMLLALPFICDGAMSLDGGMIRSAGMLVLGDRKDVEVRFPLTSPTKKMALNYLDTEEKLKLKKWEKERILDDVQREQQLLFHVKQSFESKRQEFVKNLAESSSYITQQQFQSGSRSSTPR

SEQ ID NO: 40 - protein, 127 aa, Papaver somniferum
MSAKEIRVTQPMLQGYFNPSLYIPDQPWKHITMGFIEGLTVSNKKIVIPVIVDRLTKYAHFFALQHPYTAASVSHTFLNEVFKLHGLPSSIVSDRDKVFTRKFWQDLFKALGTNLNLSTAYHPQTDG

SEQ ID NO: 41 - protein, 936 aa, Papaver somniferum
MVYASADHFQIKMWVSVSRKSNNREIFGDLLEPNVNRQSSLNVIQDCLKEKLMVGKCLIVLDDVWINHGIDVDELLKDLLSMSFQGSKILMTMRSAEDIPPMKDHRYIIYQLQGLPEDDCWSIIKDIAFGHGGAKETPNLINTGKQIAIKCGGLPLAAKTLGGLLYSRNDQEEWLSNLNTQSWELPTGESKIVSLLKFSYDHLSPYVKCFSYCSIFPKGHVFSKNEVIRMWMAEGFLISPWQANESPEIVGNGYFKILLLNSFFQDERRNIWGDIKSFRMHDLVHDLSVSITGCESLNITIDDIPKIDQSFTFRRLGLQVLHSGVSTAIPSEIYKAFKKLHTFVYSGLHDGEDVWARRVCTFGFIRVLKLSHTGIEELPKSICKLKHLRYLDVKRCNRLKELPQDIRKLIGLEYLIFRNKYTLSAKMPRKVSRLSALKKLSVFIVGEEGKGSGIEELKDLNLLGGKLSIEDLGNVTDGTQANLMGKKNIRHLELSWDSRGCNDPDRIIKDVEVINDLQPHLNLKKLGVSHFGGSEIPTWLRSASVHLPKLVSITLYRCNECEHFPALGGLQHLKYLFMDGFGGVKRIGNEFCPSNEEAVSFPSLVLLYIYHYTNSVNSDRSSRASTFSWSEDLENQNGSTLSTTPTEFPFLRKLYFHIERQVDANLKSLSPKLLWGVLQTLLVAGCNEFVGFEQQHRHQLDHLSYSHLRRLEVFKCPSLTVLPADFSGLNSLTYLAIEECSSLHSLPDGIQYLPALETLIIGGFSEDLTSFPFPAASGSDGEKYFVSLRVLKICGWPTLSAELPDQLQLLTCLQCFTIRGFPCLSSLPEWFRELSSLQNLYFLNCSRLQYLPSDEQMQRLTSLKTIYIWNCPLLLERCSGNEEGHKIARRKQGFSRLSFPRFNILLPETEPVLSLEGPCAKKFRRAFYKVNANDNS

SEQ ID NO: 42 - protein, 151 aa, Papaver somniferum
MTESKIRKLAGEKLGFDLSGKQEKKFIREIVNEFLVQKEEEVQEKGKQQVEDEEEKEEEEEEKKRKRPGVSVKEYEDNGDLIICQLSSRRKVTIQEFKGKALVSIREYYEKDGKELPSTKGISLTAEQWFTFSKSVPGIEQAIKKMQTRSR

SEQ ID NO: 43 - protein, 285 aa, Papaver somniferum
MDDHTKPFILTSISFQVIACFFTIFCILFGFFWFNKEKTKKKKCCDCDCSKKISEEEEGYKGYLNGGGEMPVRVTEGGGGGGSVSMMEQLVPEITTHALSYLDYPSLCRLSMTNSSMRKAANDDSAWKMLYHKDFTAEQDSVMPVNGWKAYYAATRAIMNINAEFFNIIRDRSVPGMGAFWLNADYVKCIHTSGEVFSGYDAVMESWQLTFNWGQGVAFQIRDVKTRVFTDIAWVTMKTYVDDPNSGPFNVTNVYEFHKGQWYLVHHHCSVILIGAEADQQNVFG

SEQ ID NO: 44 - protein, 141 aa, Papaver somniferum
MCHLLSSETKPKYFRKLESTHLLQNDHYSDCGQLCKSYLIDLEDPKLFRLFCDSRFLSEFFQTLGPNNLDPTYEEMHPRKIVYLDPFIEPEPEPQLAIVIQKLGKGMLVLYIFLVHCNFLLSALFGFKDPQLFRLLLYGSS

SEQ ID NO: 45 - protein, 181 aa, Papaver somniferum
MATILVGWSAPNTNWIKINTDGAARGHPGFAGVGFVCRDSDARTIIALAQPLGITTALTAETWAFLLASRTTTERQWPRILFETDSENLMRLITTTTTPPWYIAEMIKEIKNRLRQIPQVVVQHNYREGNQAADGLANHATDGSQTGNYSTKIWDQAISSFISHILFQDYVGTKYPRQAVN

SEQ ID NO: 46 - protein, 936 aa, Papaver somniferum; identical to SEQ ID NO: 41

SEQ ID NO: 47 - DNA, 831 bp, Papaver somniferum
ctgactcgtgagaaattagaacagaaagtaagaaaggaaagagagaagaattatagaaataatcttcaatctatctcttcttcttcttctttccagtctagggttttgtttgtttctcactcaggtcagacttttgcaaacatgacttcatcggtaatacagggttttactaaatcgcttgcgatgacagttctatctgagatcggagataagaccttctttgcagctgcaatcttggcaatgcgtcatccaaggagacttgttttagctggttgcttaggagctttaattgtaatgacgattctctctgctctagtaggttgggctgccccaaatttgattcctcgtgtatggactcaccatgtaaccacaattttattctttggctttgggctatggacattgtgggagggattttcagacaagggggatgaagatgatttggctgaagttgaggcaaaattggattctgatatgaagacaactgctgcaaaagccacaaaaggatctaaggatgatgacttgaaaaagcagaagagaccattcctcacatccctcttctcccccatcttgttgaaggcattttccattacattctttggggaatggggtgataagagccagcttgctacgattggattggctgcggatgagaatccatatggtgttgttcttggtggaatcttaggtcaagcattgtgtactactgcagctgttcttggtggcaagagtttggcttcaaacatatctgagaaaatggttgcaatctcaggtgggattctatttctgattttcggtatgcaatcctttctttcaacagtcgaaccatag

SEQ ID NO: 48 - DNA, 1095 bp, Papaver somniferum
atggagacagcaaaacttatgaagctgggtaatggcatgtcaataccaagtgttcaagaattggctaaactcacgcttgcagaaattccatctcgatacatatgcaccgtagaaaaccttcagttacctgtgggtgcatctgtaatagatgatcatgaaacagttcctgtcattgatatagaaaatttaatatcttcagaaccggtaaccgaaaagttagaattggataggcttcattctgcttgcaaagaatggggtttttttcaggtagtgaaccatggagtcgacgcttcattggtggatagtgtaaaatcagaaattcaaggtttctttaacctttctatggatgagaaaactaaatatgaacaggaagatggagatgtagaaggatttggacaaggctttattgcatcagaggaccaaacacttgattgggcagatatatttatgatgttcactcttccactccatttaaggaagcctcacttattttcaaaactcccagtgcctctcagggagacaatcgaatcctactcatcagaaatgaaaaacttatccatggttctctttaataagatggaaaaagctctacaagtacaagcagccgagattaagggtatgtcagaggtgtttaaagatgggacacaagcaatgaggatgaactattatcccccttgtcctcaaccaaatctcgccatcggtcttacgtcgcactcggattttggcggtttgacaatcctccttcaaatcaacgaagtggaaggattacagataaaaagagaggggacatggattgcagtcaaacctctacctaatgcgttcgtagtgaatgttggagatattttggagataatgactaatggaatttaccatagcgtcgatcaccgggcagtagtaaactcaacaaatgagaggctctcaatcgcaacatttcatgaccctagtctagagtcggtaataggcccaatatcaagcttgattactccagagacacctgctttgtttaaaagtggatctacatatggggatcttgtggaggaatgtaaaacaaggaagctcgatggaaaatcatttcttgactccatgaggatgtga

SEQ ID NO: 49 - DNA, 636 bp, Papaver somniferum
ttgatttgtaatcaaggtgtttttattcctgaagaatttgataaacaagaagtagatactattaagtttatgatggatgttaatttaatgggtacatttcatctgattaaagctgtgttgccgtctatgaagagtaggaaagatcgcggtccttgttctattgctttgatgtcttcacaagctggtcaggttggaatctatggttatgcggcttacgcggctagtaaatttggtcttcggggtttagcagaatccttgcagcaagaggttatttctgataacatccacatctcacttatatttcctccagacaccgaaacccctggcttagctgaagagaacaagacaaagccagagattactagtataattgccgcctcttctggtgcgaagaaagctgatgaagtagccataacagctttaaatggcatcaagtctggaagctttatcatcccatgcaattttgatggactaatgctgtctctcgcaactgctggaatgagtccccagagatcacctgcaatggcacttctggaggtggccacgactagtcttttgcgtttcgtgggttttttctatctatggaattggtatgcaagtatagagaaatggaatgcacaaaaaatccggacctaa

SEQ ID NO: 50 - DNA, 717 bp, Papaver somniferum
atgtgtaatgcagacacaagtcgaattttagttggcaatatacatgttcttttcaatcaaaaccgaggcgacatgaaattgggtcaaattcgcttgctcttgtcaaaagcacatgccctgtcggagaaatggggaaatattcctatggtgctagctggtgatttcaatatcactcctcagagtgccgtctacaagttcttgtcatcttcagagctgaatatcacgttacacgatcgcaaagatttatctggacagaagagtcgtcaccctgctcaatttactggtggaaaactcaaaccaggcattttgaaggacagcgactttgagtattgctggactgatgaagagattgaatatgccactggagattcaagtaaaactgtactcgaaaaccctttgaagctgcgcagctcctacgccacagtgaagggaactgcgagagattctcttggggaaccctcagctacttcgtatcactcaatgttccttggaactgtcgattatatttggtactcaaacgaccttgttcctacgagggttcttgataccccatcaatcaatcttttattgaagactcgcggattgccaaacaagcatttgggcagcgatcacctggcattgggttcagagttttctttcactgattgtaataaagaagataaaaatggctcaacaacaactgcagcctcaacagcagcaacagaaattgtagaatga

SEQ ID NO: 51 - DNA, 813 bp, Papaver somniferum
atgattctaccggcaatttcatcttcttctccagcgattacagttcgtattccttgtcgtttaactattggttttctttctcggagaaagaaaatggccgtatctcaattctcatcttcttcaccatcaaccttaatctcatgcgcatctgcatccacaaccacaagcacaacgacggcaactgatggtaaacctaaaccatggttattcgttggtcttggcaaccctggaaagttatataacggaaccagacataatgtgggatttgagttggtagatgctatagctgaagctgaaggaatatcaatgagtagtgtttcgtttaaagctctatctggaaaaggccatataggagatgttcctgttatgcttgcaaaaccacaaactttcatgaatttgagtggtcaatcggttggttccatcgtttcatattacaagataccgttgaagcaagtagttgtgatatttgatgacatggatttgcctttcggagcattacgtttattgccgaaaggtggacatggagggcacaatgggatgagaagtgtcattgaccatttcaagggtagccgtgattttccacggttgagaataggaattggacgacctactggcaaaatggatggtgcatcgtttgttcttcgacctttcaataaacaagagcgcgaagagctggatttcactttccaaaatggatatgacgcgttaaggatacttttgcttgagggatttgataaaagtgctgcatttactaattctgcatcaaagtccgcatcgaagtccgaatcaaagtctatgaaacagcttggttaa

SEQ ID NO: 52 - DNA, 966 bp, Papaver somniferum
atggagagtaatggtgttcctatgattactctcagttccggcattcggatgcctgctttaggtatgggaacagttgaaacaatggaaaagggaactgaaagagagaaattggcgtttttgaaagcgatagaggtcggttacagacacttcgatacagctgctgcataccaaactgaagagtgtcttggtgaagctatagctgaagcacttcaacttggtctaataaaatctcgagatgaactcttcatcacttccaagctctggtgcgctgatgctcacgctgatcttgtcctccctgctcttcagaattctctgaggaatctcaaattggactatcttgatctatatttgatacaccatccggtaagcttgaagccagggaagtttgttaacgaaataccaaaggatcatatccttccaatggactacaaatctgtatgggcagccatggaagagtgtcagacccttggcttcactagggcaatcggggtctgtaatttctcatgcaaaaagcttcaagagttgatggcaacagccaacagccctccagttgtgaatcaagtggagatgagcccgactttacatcaaaaaaatctgagggaatattgcaaggccaataatatcatgatcaccgcacactcagttttgggagccgtaggtgccgcctggggcaccaatgcagttatgcattctaaggtgcttcaccagattgctgtggccagaggaaaatctgttgcccaggttagtatgagatgggtttaccagcaaggcgcgagtcttgtggtgaaaagtttcaatgaagcgaggatgaaggaaaaccttaagatatttgattgggaactaacggcagaagacatggaaaagatcagtgagattccacaatctagaacaagctctgctgctttcttgttatcaccgactggacctttcaaaactgaagaagagttctgggatgagaaggattga

SEQ ID NO: 53 - DNA, 2376 bp, Papaver somniferum
atgtctatcaaattcaagttcagaagctcagtgaatttcgattctattgatttagaagattcaccatcagtatcagtcagagatcttaaatcaagaataattaatcaaagtaaattgaagatttgtcaagattttgatcttgttctatctaatgccattactggacaagagtttgaagatgaggaatttcttgttgaaagcggttcaagtgttataattaagagagtaccagttgatagagatgctaattctgttcggccagcggttgagaatatggcaaaaaaacactatccttctgttcatactaatgaaccgactcttccggcagtgtgtggcaagaacgttgaagtcgaaaacttcgatgactttgggattgatctgtatcctgctccagagacacctttgttggactcggacctcgatgatgataaagtcaattgtaccagcagtgtacatgcagataaggaaattcctagatgctctggttctggtccatcaggagtgaaacatcaaaatattgaaaaaagtgatcctagtgaaggtattccgaaagtgcaagtaatgttaaaatctaaaatggaagagcataagaagttgaacgaagtggtagatgaaagatccttagcaatacctaaagctgatctaccatccgagctgagatgttctctttgcaactcgatattcaaagaggctgtgatgataccgtgctgccaacatagcttttgcgacaaatgcattcgttctgttttggatgaaaaggcaagatgtcccaagtgttcttcaaccaaatgtaaagttgaagacttgctgccgaatatctctctaaggcaggccattgaacattttcttgagtctcaaggacttatgagtggttcagacaacatatttcaaaagtatgccccagatgaagcatctggaatacaagcaaaagagttcggctgcgtggtgtctattcatcaacgagactcgcagttacctcattctccatctgctactgggaaaggctccaatcaagttatgactgaatctgtgtatgaatcaacattccgaaacaatggatctgctgccggcaaaagatcagcctcgtcactaaaagcagtaccagaaaacttcacacctcttgctgagtatgaaggggaaaaccagcccttaaaagttccagcaaatcacctgcaaaatgaggaagccaggagaaagaaaatgtggcataaccctgcagatggatctggaaattttacaagcacaggcaaatacagaaagggtgatcgtacttgttatatgtgtggttctcctgatcatttcattaaagactgtccagtttcttccaatcagtatccaatgcttcagacaggtaatgctgtgtaccaaggaggtatgccagcttatgggccaccaccttattggaatggcccccaatttaggccctttccaaatgtttatgcgactcctggcatgatgccctatggttccaatatggtcccagtaaatccttatgcagttcattcatatatgccgtcaatgtatgctggcatgcaagcaccctatggggttatggggatgggaggtttggcacctccgatggtgtctggtcccactgggcgagaacaccatcttatgcgaccagattatatggagtttcaaattaatgaacagaaaaacagactcgtaaaggagcatttagagagagaggaagcgcatggtggtgattattacccagacgacggctatcccgccattaagccccaactttcacatgaatataaacctcaatcagaaaaggagaaccactacagttactctgacgaagacattgatgtacaaagatcacaaaggaagcatatacgtgacagacgtcttgatcaggaggggagccttatcgagcaaagacatgagaaggtatctcgtaccccagcatctggaagagatcattgggtacgtaacttcgaggaatctagtccagatatacatgaaacatccaacaactctgtccgccacaataaagacagtaaacataagcatcaccagagaaattctaagacagaacgaaggggtgactgtgttagtgattctggccggaaaagtcaccaccatgaaagctccaaagaagttgctaccaacagaaagaggtctgaggctgatgccaaaagatatagtcggaaacatcatagccacacaaattctgaccaggaacctagttcatctggaagttccaagagacatcgaagagaaaaagattcggctcacagttcgaagcagccccgccatttgaaatccaaaaatgataatgaaaggtgggagatggtcgatggtttggaagaagactgcagggaggatcaccatcatcgtttacaccacaagggtaagagagtccactaa

SEQ ID NO: 54 - DNA, 798 bp, Papaver somniferum
atgggagaatgggaaaatatgaaaccttcagatcaaacttcacaactagtattcaaaccactaatgatttctatggttggaatagcattcacagctctagcaatcgtgacataccagttcattataaccaagtactgtgtacgaagacgcgaatcgatgatagaaagaaatgaattaagaagtcatcaagctatggttaatcgcggtgttgacgaaaacgtacttaaagctattccaattataacttatcatcatcaacaacaacaacaaagtagagatgaagaagaagaagtcttttgtgtggatcaaactgagtgttctgtttgtttaggtgatttacaagaaggtgatatgctaagattattacctaactgtaaacatgtttttcatgttccttgtattgatcaatggtggttaactcattctacttgtccgatatgtcgttcccctgtcacgggacggaacgatgactccgtgtgtcttcaaatacaagccgaaggagatgaagaaggtctagttagtcatcaacatcatcaagaacaacaatataattgcagcgaagggagtaacaataatgaaggtggcaattcttcaataatggtaggttcaaaacttagacactgtgtgtcgcttatatggccggctaattatgaagatgaggttagaaaacagcagtctaaaactgttttgttaaagagatccatgtctgtggattgttcttttgtttgcattaaaatacaaccaagaacggattcatcttcttcatcatcgtcaacttggaagacaacttcaaagtag

SEQ ID NO: 55 - DNA, 795 bp, Papaver somniferum
atggcgacatcttcctcttggttcagtcttgtatccatgtacgagtctcatctcagaaacacattcacttcctctggtctcactccgaaatccattaacatcgattctgatactaatatccattattggtcaccaatacacccattaacactaccaacactagtcctgctccacggttttggaggaaactgtctttggcaatggagtaagcaagttcaacatctctctacccatttcactttgtatgtccctgaccttatatatttcggcaagtctgtaacaaaatcttcagagcgttcggaaaattttcaagcggtttcagttggaaaattacttgagttgttgggtgttacaacgtattcggttatgggtacaagttatggtggttttgttgcttatcatatggctagactatggcctgacagagtcgagaaagtcgttatagccaattcggctttaaatatcacgtcaaaagatgttgaagagttgctgaaggaagcaaatattgagaatattgaaagtgtgtttatgccgtcatcgcctgctgagttactaacttgtatccgattaattcataagcagttaccgacttatgtaccagagttttttctgaatgattttcttgataatttgtgtaatgaaaacaggaaggaaaagttagagcttctcaagggaaccacagttgggaaagaggatacaatatccattctgcctcttcaacaggaggtgttactaatatggggggagaatgacgcaatatttccattggagaagggttatgagcttaaagagtaa

SEQ ID NO: 56 - DNA, 1632 bp, Papaver somniferum
ctgaaaacctctcaaaaagcattagaattctttaagttttgttctgatgaaatccctgggtttaaacatgattgttttacttataatcggattcttaccatcttatcgaagtcgaattcgttggaaattgtgaaatcagttgtggatgagatggagaaatgtgggattaaagggaatatatctactgttaatatattgattgggatttttgatggggttttggaattggagaaatgtgttgggttagttaagaaatgggggttattgtttaattgttatacttataaatgtttacttcaagcttatttgaggtgtaatgaggtttcgaaggcttttcatgtttatattgaaatgagaaggaaaggttatgttctggatatctttgcttataatatgctattggatgctcttgccaaagatgataaggctgagcaggcatctaaagtttttgcagacatgaagcggaagcactgtgagcccgatgggtatacatacacaattatgatcaggatgaatggaaagattgggaaagcagaggaatgtttgtctctctttcaagatatgataaccaagggatgttcccccaatttgattgcctataataccatgattcaagcacttgcaaggaaccatatggttgataaaatggtttttcttttctctaaaatggttgagaagggatgccagccaaatgaattcacatacagtgttattttggatggtcttgctgcagaaggtcaacttaccagattagatgaggttgtggaaatgtctaagaaatacatgcacaaaggtatctattcttatttggtgaagacactgagtaaatcaggtcatgcaagtgaagctcataggctgttttgtaatatgtggaattttaatgatgggggtgatagggatgcttatatgtctatgctggagagtctatgccattcaggaaaaactgcagaagctctcgaccttctcaataaaattcatgaaaaaggaatcatgactgatacagtcatgtataacatggtattctctgctcttggcaagttgaagcagatttctcaaattcacgatctttatgagcatatgaagataaacggcccttccccaaacatattcacctataatattcttcttgctggttatggtagagctggcggagttgatgacgcagttaaactatttgaagagatggagaatggcgattgtcgaccagatatcattacttacaattctttgatcaattgtcttggcaaaaatggtgacctcgatgaagcccacatgaaattcaaggagatgcaagagaagggtttgaatcctgatgttgtaacttacagtaatctcattgagtgctttgggaaaaagaatagggttgaaatggctctcactttgtttcatgagatgcgtgcagaaacttgttaccctaacattgtgacatataatattttactcgattgtcttgagaagtgtggcaaaagatcagaagcacttgagctgtatgctaagctgaaacagcaaggactaactccagatactattacgtacgctgttcttgaccgtttgcaaagtaaatcacataaaactgtaagaatacgaaggcagagtcctatttcaggatgggtttttagccctataggctga

SEQ ID NO: 57 - DNA, 684 bp, Papaver somniferum
atgagttttcttttcgggaaaaggaagactcctgcagagcttctgcgggagaataagaggatgttggataaatctattagagaaattgagagggagagacaagggttacaggcgcaagagaagaaacttattgtggagattaagaaaagcgctaagcaagggcagatgggagctgtgaaagttatggcgaaagatctaatcagaacaagacaccaagtcgaaaagttctataaactcaaatcacaactccaaggggtatctctcagaattcagacattgaaatcaacccaagcaatgggagaggccatgaaaggtgtaaccaaggcaatgggacagatgaataggcagatgaatttgccatcattgcagaagataatgatggagtttgagaggcaaaatgagaagatggaaatgacaagtgaggtaatggctgatgctattgatgatgctttggagggagatgaggaagagcaggaaactgaggatcttgtgaaccaggtcctcgatgagattggaattgacatcaattcagagctcatgaacgcgcctgcaacagcggtagctgcaccagccgcaactaccaaagtagctcaagctgaacaacctgcagcagcaggaggtaatgacgatggtggtatagatatggatcttcaagcaaggttggacaacttaaggagaatgtaa

SEQ ID NO: 58 - DNA, 1767 bp, Papaver somniferum
atgagtctgcaacaagctggacagcccaggcctactgcgaatgggactggtcgtcgaagaggggaacgggaaacagggtttcggtcaggaagtaattttcctaccgaaaagccaaatcatggaatggccattgttggaggtatactgaatggaagcatagagggaggccttgaaggtccttcacgtgatcgattgatatatttggcagcgtgtcttatcggacatcgcgtggaggtccaagtgaaaaatggatctatattttctgggatacttcatgcaatgaatgccgaaaatgattttggaattgtcctgaaaatggcttctctaaccaaagatggtttgtccaaaggacataagcctggttctgattctattagcaaggcaccttcaaagactttgatagtacctgctaaagaacttgtgcaagtcattgcaaaggatgtgtcggtaactggcagtggagtgaaaaatgatggacaccatgaaggacgtcaggaccttatgatagactcctacatatctaaatctcaatttgttgatgcggggagagaactggcaccctgggcacctgatgaagatgatttgcagtgtcctgaattggacaacatatttgatggcccctggaatagtaggaaatgggatcagtttgaaactaatgaggcattatttggagttaagagtaccttcgacgaggaactgtacacaacaaaacttgacagaggccctcaaatgagagagcgagaaagagaagcttccagaatagctagagagattgagggggaggatactaaagatatgcatttagctgaggaaagaggtcgtcactttgatcttgatgtggatgaggagaccagattctcatcagtcttgaggacagtggacgatagtggatacgatgaagatgaggacattgtattagatactcacaatatggagacctttggtgattcttcaggtgcagcatctaaaagatccttttctgatgtggctagagggaagacagacaatcttggtccatcaccgagctcttcgtcagtggcggatgaagcacattctcgcttcaatgctggtcgggatcacttctctgcttctggtgatcgtgcaagacaaattgatagtgagagcactcagagcagggtgtatgagaacaaattcaaagaactggatggtcggaagaacggcgcaaaagagttagtggaaagaaaacctgtcaatgaagctcaaacacaaaaccttgaagggtctagaaaatctcaggttacaacacagcatgtacatcctcgaggacgtccagggagttcagcgtcttctactgcagagtctgcgcagagtggggttgccccgactttgggtcgtcctggtttgtcacctagctcctccatggggtcattgtcttccgagaaatcaactttaaatccttttgcaaaggagtttaaacttaatccaaatgcaaagagtttcactccctcaccagcaccaatacggcctccttctccggtatctgatagttcatattactatccaaacaatgtttctcctgtccaacatatgcacggactacctgttggtgtcgggatggggacatcatatggcggaccccagcctgttatgtacactccacaagttgcacctatacaaccagctcagacatttttgcaccctaatggacaactgtatggacagcagatgattgttggccaccctaggcaagtactatacatgccaagctatcctccggacatgccatacaagggaagagatttctaa

SEQ ID NO: 59 - DNA, 966 bp, Papaver somniferum
atggagagtaatggtgttcctatgattactctcagttccggcattcggatgcctgctttaggtatgggaacagttgaaacaatggaaaagggaactgaaagagagaaattggcgtttttgaaagcgatagaggtcggttacagacacttcgatacagctgctgcataccaaactgaagagtgtcttggtgaagctatagctgaagcacttcaacttggtttaataaaatctcgagatgaactcttcatcacttccaagctctggtgcgctgatgctcacgctgatcttgtcctccctgctcttcagaattctctgaggaatctcaaattggactatcttgatctatatttgatacaccatccggtaagcttgaagccagggaagtttgttaacgaaataccaaaggatcatatccttccaatggactacaaatctgtatgggcagccatggaagagtgtcagaccgttggcttcactagggcaatcggtgtcagtaatttctcatgcaaaaagcttcaagagttgatggcagcagccaagatccctccagttgtgaatcaagtggagatgagcccgactttacatcaaaaaaatctgagggaatattgcaaggccaataatatcatgatcactgcacactcggttttgggagccataggtgctccatggggcagcaatgcagttatggattctaaggtgcttcaccagattgctgtggccagaggaaaatctgttgcccaggttagtatgagatgggtttaccagcaaggcgcgagtcttgtggtgaaaagtttcaatgaagggaggatgaaggaaaaccttaagatatttgattgggaactaacggcagaagatatggaaaagatcagtgagattccgcaatctagaacaagctctgctgatttcttgttatcaccgactggacctttcaaaactgaagaagagttctgggatgagaaggattga

SEQ ID NO: 60 - DNA, 1083 bp, Papaver somniferum
atggagacaccaatacttatcaagctaggcaatggtttgtcaataccaagtgttcaggaattggctaaactcacgcttgcagaaattccatctcgatacacatgcaccggtgaaagcccgttgaataatattggtgcgtctgtaacagatgatgaaacagttcctgtcatcgatttgcaaaatttactatctccagaacccgtagttggaaagttagaattggataagcttcattctgcttgcaaagaatggggtttctttcagctggttaaccatggagtcgacgctttactgatggacaatataaaatcagaaattaaaggtttctttaaccttccaatgaatgagaaaactaaatacggacagcaagatggagattttgaaggatttggacaaccctatattgaatcggaggaccaaagacttgattggactgaagtgtttagcatgttaagtcttcctctccatttaaggaagcctcatttgtttccagaactccctctgcctttcagggagacactggaatcctacctatcaaaaatgaaaaaactatcaacggttgtctttgagatgttggaaaaatctctacaattagttgagattaaaggtatgacagacttatttgaagatgggttgcaaacaatgaggatgaactattatcctccttgtcctcgaccagagcttgtacttggtcttacgtcacactcggattttagcggtttgacaattctccttcaacttaatgaagttgaaggattacaaataagaaaagaagagaggtggatttcaatcaaacctctacctgatgcgttcatagtgaatgttggagacattttggagataatgactaatgggatttaccgtagcgtcgagcaccgggcagtagtaaactcaacaaaggagaggctctcaatcgcgacatttcatgactctaaactagagtcagaaataggcccaatttcgagcttggtcacaccagagacacctgctttgttcaaaagaggtaggtatgaggatattttgaaggaaaatctttcaaggaagcttgatggaaaatcatttctcgactacatgaggatgtga

SEQ ID NO: 61 - protein, 276 aa, Papaver somniferum
MTREKLEQKVRKEREKNYRNNLQSISSSSSFQSRVLFVSHSGQTFANMTSSVIQGFTKSLAMTVLSEIGDKTFFAAAILAMRHPRRLVLAGCLGALIVMTILSALVGWAAPNLIPRVWTHHVTTILFFGFGLWTLWEGFSDKGDEDDLAEVEAKLDSDMKTTAAKATKGSKDDDLKKQKRPFLTSLFSPILLKAFSITFFGEWGDKSQLATIGLAADENPYGVVLGGILGQALCTTAAVLGGKSLASNISEKMVAISGGILFLIFGMQSFLSTVEP

SEQ ID NO: 62 - protein, 364 aa, Papaver somniferum
METAKLMKLGNGMSIPSVQELAKLTLAEIPSRYICTVENLQLPVGASVIDDHETVPVIDIENLISSEPVTEKLELDRLHSACKEWGFFQVVNHGVDASLVDSVKSEIQGFFNLSMDEKTKYEQEDGDVEGFGQGFIASEDQTLDWADIFMMFTLPLHLRKPHLFSKLPVPLRETIESYSSEMKNLSMVLFNKMEKALQVQAAEIKGMSEVFKDGTQAMRMNYYPPCPQPNLAIGLTSHSDFGGLTILLQINEVEGLQIKREGTWIAVKPLPNAFVVNVGDILEIMTNGIYHSVDHRAVVNSTNERLSIATFHDPSLESVIGPISSLITPETPALFKSGSTYGDLVEECKTRKLDGKSFLDSMRM

SEQ ID NO: 63 - protein, 211 aa, Papaver somniferum
MICNQGVFIPEEFDKQEVDTIKFMMDVNLMGTFHLIKAVLPSMKSRKDRGPCSIALMSSQAGQVGIYGYAAYAASKFGLRGLAESLQQEVISDNIHISLIFPPDTETPGLAEENKTKPEITSIIAASSGAKKADEVAITALNGIKSGSFIIPCNFDGLMLSLATAGMSPQRSPAMALLEVATTSLLRFVGFFYLWNWYASIEKWNAQKIRT

SEQ ID NO: 64 - protein, 238 aa, Papaver somniferum
MCNADTSRILVGNIHVLFNQNRGDMKLGQIRLLLSKAHALSEKWGNIPMVLAGDFNITPQSAVYKFLSSSELNITLHDRKDLSGQKSRHPAQFTGGKLKPGILKDSDFEYCWTDEEIEYATGDSSKTVLENPLKLRSSYATVKGTARDSLGEPSATSYHSMFLGTVDYIWYSNDLVPTRVLDTPSINLLLKTRGLPNKHLGSDHLALGSEFSFTDCNKEDKNGSTTTAASTAATEIVE

SEQ ID NO: 65 - protein, 270 aa, Papaver somniferum
MILPAISSSSPAITVRIPCRLTIGFLSRRKKMAVSQFSSSSPSTLISCASASTTTSTTTATDGKPKPWLFVGLGNPGKLYNGTRHNVGFELVDAIAEAEGISMSSVSFKALSGKGHIGDVPVMLAKPQTFMNLSGQSVGSIVSYYKIPLKQVVVIFDDMDLPFGALRLLPKGGHGGHNGMRSVIDHFKGSRDFPRLRIGIGRPTGKMDGASFVLRPFNKQEREELDFTFQNGYDALRILLLEGFDKSAAFTNSASKSASKSESKSMKQLG

SEQ ID NO: 66 - protein, 321 aa, Papaver somniferum
MESNGVPMITLSSGIRMPALGMGTVETMEKGTEREKLAFLKAIEVGYRHFDTAAAYQTEECLGEAIAEALQLGLIKSRDELFITSKLWCADAHADLVLPALQNSLRNLKLDYLDLYLIHHPVSLKPGKFVNEIPKDHILPMDYKSVWAAMEECQTLGFTRAIGVCNFSCKKLQELMATANSPPVVNQVEMSPTLHQKNLREYCKANNIMITAHSVLGAVGAAWGTNAVMHSKVLHQIAVARGKSVAQVSMRWVYQQGASLVVKSFNEARMKENLKIFDWELTAEDMEKISEIPQSRTSSAAFLLSPTGPFKTEEEFWDEKD

SEQ ID NO: 67 - protein, 791 aa, Papaver somniferum
MSIKFKFRSSVNFDSIDLEDSPSVSVRDLKSRIINQSKLKICQDFDLVLSNAITGQEFEDEEFLVESGSSVIIKRVPVDRDANSVRPAVENMAKKHYPSVHTNEPTLPAVCGKNVEVENFDDFGIDLYPAPETPLLDSDLDDDKVNCTSSVHADKEIPRCSGSGPSGVKHQNIEKSDPSEGIPKVQVMLKSKMEEHKKLNEVVDERSLAIPKADLPSELRCSLCNSIFKEAVMIPCCQHSFCDKCIRSVLDEKARCPKCSSTKCKVEDLLPNISLRQAIEHFLESQGLMSGSDNIFQKYAPDEASGIQAKEFGCVVSIHQRDSQLPHSPSATGKGSNQVMTESVYESTFRNNGSAAGKRSASSLKAVPENFTPLAEYEGENQPLKVPANHLQNEEARRKKMWHNPADGSGNFTSTGKYRKGDRTCYMCGSPDHFIKDCPVSSNQYPMLQTGNAVYQGGMPAYGPPPYWNGPQFRPFPNVYATPGMMPYGSNMVPVNPYAVHSYMPSMYAGMQAPYGVMGMGGLAPPMVSGPTGREHHLMRPDYMEFQINEQKNRLVKEHLEREEAHGGDYYPDDGYPAIKPQLSHEYKPQSEKENHYSYSDEDIDVQRSQRKHIRDRRLDQEGSLIEQRHEKVSRTPASGRDHWVRNFEESSPDIHETSNNSVRHNKDSKHKHHQRNSKTERRGDCVSDSGRKSHHHESSKEVATNRKRSEADAKRYSRKHHSHTNSDQEPSSSGSSKRHRREKDSAHSSKQPRHLKSKNDNERWEMVDGLEEDCREDHHHRLHHKGKRVH

SEQ ID NO: 68 - protein, 265 aa, Papaver somniferum
MGEWENMKPSDQTSQLVFKPLMISMVGIAFTALAIVTYQFIITKYCVRRRESMIERNELRSHQAMVNRGVDENVLKAIPIITYHHQQQQQSRDEEEEVFCVDQTECSVCLGDLQEGDMLRLLPNCKHVFHVPCIDQWWLTHSTCPICRSPVTGRNDDSVCLQIQAEGDEEGLVSHQHHQEQQYNCSEGSNNNEGGNSSIMVGSKLRHCVSLIWPANYEDEVRKQQSKTVLLKRSMSVDCSFVCIKIQPRTDSSSSSSSTWKTTSK

SEQ ID NO: 69 - protein, 264 aa, Papaver somniferum
MATSSSWFSLVSMYESHLRNTFTSSGLTPKSINIDSDTNIHYWSPIHPLTLPTLVLLHGFGGNCLWQWSKQVQHLSTHFTLYVPDLIYFGKSVTKSSERSENFQAVSVGKLLELLGVTTYSVMGTSYGGFVAYHMARLWPDRVEKVVIANSALNITSKDVEELLKEANIENIESVFMPSSPAELLTCIRLIHKQLPTYVPEFFLNDFLDNLCNENRKEKLELLKGTTVGKEDTISILPLQQEVLLIWGENDAIFPLEKGYELKE

SEQ ID NO: 70 - protein, 543 aa, Papaver somniferum
MKTSQKALEFFKFCSDEIPGFKHDCFTYNRILTILSKSNSLEIVKSVVDEMEKCGIKGNISTVNILIGIFDGVLELEKCVGLVKKWGLLFNCYTYKCLLQAYLRCNEVSKAFHVYIEMRRKGYVLDIFAYNMLLDALAKDDKAEQASKVFADMKRKHCEPDGYTYTIMIRMNGKIGKAEECLSLFQDMITKGCSPNLIAYNTMIQALARNHMVDKMVFLFSKMVEKGCQPNEFTYSVILDGLAAEGQLTRLDEVVEMSKKYMHKGIYSYLVKTLSKSGHASEAHRLFCNMWNFNDGGDRDAYMSMLESLCHSGKTAEALDLLNKIHEKGIMTDTVMYNMVFSALGKLKQISQIHDLYEHMKINGPSPNIFTYNILLAGYGRAGGVDDAVKLFEEMENGDCRPDIITYNSLINCLGKNGDLDEAHMKFKEMQEKGLNPDVVTYSNLIECFGKKNRVEMALTLFHEMRAETCYPNIVTYNILLDCLEKCGKRSEALELYAKLKQQGLTPDTITYAVLDRLQSKSHKTVRIRRQSPISGWVFSPIG

SEQ ID NO: 71 - protein, 227 aa, Papaver somniferum
MSFLFGKRKTPAELLRENKRMLDKSIREIERERQGLQAQEKKLIVEIKKSAKQGQMGAVKVMAKDLIRTRHQVEKFYKLKSQLQGVSLRIQTLKSTQAMGEAMKGVTKAMGQMNRQMNLPSLQKIMMEFERQNEKMEMTSEVMADAIDDALEGDEEEQETEDLVNQVLDEIGIDINSELMNAPATAVAAPAATTKVAQAEQPAAAGGNDDGGIDMDLQARLDNLRRM

SEQ ID NO: 72 - protein, 588 aa, Papaver somniferum
MSLQQAGQPRPTANGTGRRRGERETGFRSGSNFPTEKPNHGMAIVGGILNGSIEGGLEGPSRDRLIYLAACLIGHRVEVQVKNGSIFSGILHAMNAENDFGIVLKMASLTKDGLSKGHKPGSDSISKAPSKTLIVPAKELVQVIAKDVSVTGSGVKNDGHHEGRQDLMIDSYISKSQFVDAGRELAPWAPDEDDLQCPELDNIFDGPWNSRKWDQFETNEALFGVKSTFDEELYTTKLDRGPQMREREREASRIAREIEGEDTKDMHLAEERGRHFDLDVDEETRFSSVLRTVDDSGYDEDEDIVLDTHNMETFGDSSGAASKRSFSDVARGKTDNLGPSPSSSSVADEAHSRFNAGRDHFSASGDRARQIDSESTQSRVYENKFKELDGRKNGAKELVERKPVNEAQTQNLEGSRKSQVTTQHVHPRGRPGSSASSTAESAQSGVAPTLGRPGLSPSSSMGSLSSEKSTLNPFAKEFKLNPNAKSFTPSPAPIRPPSPVSDSSYYYPNNVSPVQHMHGLPVGVGMGTSYGGPQPVMYTPQVAPIQPAQTFLHPNGQLYGQQMIVGHPRQVLYMPSYPPDMPYKGRDF

SEQ ID NO: 73 - protein, 321 aa, Papaver somniferum
MESNGVPMITLSSGIRMPALGMGTVETMEKGTEREKLAFLKAIEVGYRHFDTAAAYQTEECLGEAIAEALQLGLIKSRDELFITSKLWCADAHADLVLPALQNSLRNLKLDYLDLYLIHHPVSLKPGKFVNEIPKDHILPMDYKSVWAAMEECQTVGFTRAIGVSNFSCKKLQELMAAAKIPPVVNQVEMSPTLHQKNLREYCKANNIMITAHSVLGAIGAPWGSNAVMDSKVLHQIAVARGKSVAQVSMRWVYQQGASLVVKSFNEGRMKENLKIFDWELTAEDMEKISEIPQSRTSSADFLLSPTGPFKTEEEFWDEKD

SEQ ID NO: 74 - protein, 360 aa, Papaver somniferum
METPILIKLGNGLSIPSVQELAKLTLAEIPSRYTCTGESPLNNIGASVTDDETVPVIDLQNLLSPEPVVGKLELDKLHSACKEWGFFQLVNHGVDALLMDNIKSEIKGFFNLPMNEKTKYGQQDGDFEGFGQPYIESEDQRLDWTEVFSMLSLPLHLRKPHLFPELPLPFRETLESYLSKMKKLSTVVFEMLEKSLQLVEIKGMTDLFEDGLQTMRMNYYPPCPRPELVLGLTSHSDFSGLTILLQLNEVEGLQIRKEERWISIKPLPDAFIVNVGDILEIMTNGIYRSVEHRAVVNSTKERLSIATFHDSKLESEIGPISSLVTPETPALFKRGRYEDILKENLSRKLDGKSFLDYMRM

SEQ ID NO: 75 - DNA, 1605 bp, Papaver somniferum
atgatgaagaaagtaatcaaatatgatatggaggtagctacctcagctgattcagtatgggcagtttacagttcgccggatatccctagacttctcagagatgttctacttcccggtgtctttgagaagttagacgtcattgaaggaaatggcggcgtcggtacagttcttgacattgtttttcctccaggtgcggttcctcgaagttacaaagagaaattcgtaaacatcgatcgcgaaaagcgattgaaagaggttatcatgatcgaaggaggataccgggacatgggatgcacattttacttggacaggatccatgtggtggagaaaaccccgagctcatgcgttattgaatcttctattgtttatgaagtgaaagaagagtatgctgatgccgtgtctaaattaatcacaactgaaccattgaagtcgatggcggaagtcatctctaattacgttatacagaaagaatcagtttcgccaagaattaatattctcgacaagcaatctcaagtgaagaaggagattcgatacgacctggaggtaccaacctcggctgattctatctggtcagtttacagctgccctgatatccctcggcttcttagagatgttctacttcccggtgtgttcgagaaattggatgtcattgaaggaaacggtggcgttgggactgttcttgatattgttttccctccaggtgcggtaccacgtagttacaaggagaaatttgttaacattaaccacgagaagcgattaaaagaagtgattatgatcgaagaagggtacttagacatggggtgcacatcttacctggataggatccatgtagttgaaaaaacctctaaatcttgtatcattaaatcatctgtggtttatgaagtgaaacgagagtgtgctgatgccatgtctaagttaatcacgacagaaccattgaagtcgatggcagaagtcatctctaattacgctatcaagcaacaatcagcttctgagagaaacattcctaagaagcaatctgctctaattaggaaagaaattaattacgaaacggaggtgcaaacctcagctgattcgatttggaacgtctacagttcccctgacatccatcgactacttagagatgttctgcttcctggtgttttcgaaaagctagatgtcattgcaggcaatggtggcgttggtactgtactggatattgctttccctctaggtgcagttccgcggaggtataaggagaaatttgtgaagattaaccatgagaagcgactgaaagaagtggttatgatcgaaggaggatacctagacatgggttgcacattctacatggacaggatccatgtctttgagaaaaccccaaactcatgtgttatcgaatcctcgatcatttacgaagttaaagaagagtatgctggtaaaatggctaagctaatcacaacagaaccattggaatccatggcagaagtcatctctggttatgttcttaagaaacggctccaggtattcggattcgagattaagccaaaattaagattcaatcttttgctatgtttgattatctgtttggctgtagccggaggtatgtttgtcgctggttttccactctaa

SEQ ID NO: 76 - DNA, 210 bp, Papaver somniferum
atgagatgtcttcgaagggacaattggaccgtagtatcatcggtttgtctttttcaaaatggtctgcactatgcgccagcagcaagagttccagcgtctggacttgttagccatgaattagctagcttcagcttcagtaaacggatagtacctggatttgactatcagcaacagcaatatgaagagaagaaagttaatcataaacagtaa

SEQ ID NO: 77 - DNA, 201 bp, Papaver somniferum
atgggatggcctgaaccagatgcaggattcatggaccaacgcaacgagataccaaatgacactaaccctcattgggcatctctaatcgagagttcctggcacagtgacccaaaatgccggccaacatttaaggaactgcttgaaaggttgaaagatctgcagagacattatttcatttcaaagcccaagagaactatctag

SEQ ID NO: 78 - DNA, 510 bp, Papaver somniferum
atgcttattaggagaagcaaaaccactttctttttagacatggatgatgatcaagatttcaactacaagaaaccagcagatacttgtaagcaaacagtgagaaattccttgatctcaaatgaagcctcctcatctgcatcaaattcatcagtagggttaagaatactcattcacaaccattctacctctcctcaagaatcaaagaacacagtcttagtcaaacacactttcaaactgagtcttctagcctcaacatattctcaagaatcaagttttttgagatcatgttgtctgtgcaagaaaaagttaagtcctgaaaagaatgtgtacatgtacatgggtgatcaaggcttttgcagcgtcgactgccggtctaggcagattgtgaaggatgaaataagagaaatcgaaatatcaaccaagaaaatattgtcatcatctccttgttgtcccaagaatgtaagaattcatcttccatctcatcggaatcgaattccagttgcagcatag

SEQ ID NO: 79 - DNA, 447 bp, Papaver somniferum
atgcttaggagaaccaaaagcaccctagttttgcaagattctttctcttcttccctaaccaaagagaattctatattttctcaagattcaaacaacaaacccactttcaaattgagcgaacaaggatcattcgaaacatcatcaccaaagatgtcttcaatcttttctcaagaatcatcaaactttttgaaagcatgtggtctgtgcagaaaaaaattaactccacaaaagaatatttacatgtatagaggtgaccaagccttttgtagtgacgattgccggtgccggaaaattttgatagaggaattattgatggaagaaacagaagagaagacgacgatggaattagttacaaaaaaagagatagcaccatcttctgtacattttggaagaagccttggaaatggtctacaaccacggcgaaatcatgttcgagctgcagcttaa

SEQ ID NO: 80 - DNA, 1842 bp, Papaver somniferum
atgatgaagaaagtaatcaaatatgatatggaggtagctacctcagctgattcagtatgggcagtttacagttcgccggatatccctagacttctcagagatgttctacttcccggtgtctttgagaagttagacgtcattgaaggaaatggcggcgtcggtacagttcttgacattgtttttcctccaggtgcggttcctcgaagttacaaagagaaattcgtaaacatcgatcgcgaaaagcgattgaaagaggttatcatgatcgaaggaggataccgggacatgggatgcacattttacttggataggatccatgtagtggagaaaaccaagagctcatgcgttattgaatcgtctattgtttacgatgtgaaagaagagtgcgccgatgccatgtctaaattgatcacaactgaaccattgaagtccatggcggaagtcatttctaattacgttattcagaaagaatcattttctgccagaaacattctaagcaagcaatctgtagtgaagaaggagattcgatacgacctggaggtaccaatctcagctgattctatctggtcagtttacagctgccctgatatccctcggcttcttagagatgttctacttcctggtgtgttcgagaaattggatgtcattgaaggggatggtggtgttgggactgttcttgacattgtcttccctccaggtgcagttcctcgaagttacaaagagaaattcgttaacattgaccgcgagaagcgattgaaagaggttatcatgatcgaaggaggatacttggacatgggatgcacgttttacttggacaggatccatgtagtggagaaaagcctgagctcgtgtgttatcgaatcgtctattgtttatgaagtaaaagaagagtatgttgatgccatgtctaaattaatcacaactgaaccattgaagtcgatggcggaagtcatctctaattacgttatccagagagaatcattttccgcaagaaacattctcaacaaaaattctttggtgaagaaggagattcggtatgacctggaggttccaacctcagctgattctatctggtcagtttacagctgcccggatattcctcggcttcttagagatgttttacttcccggtgtgttccagaaattggatgttatcgaagggaatggtggtgttggtacagttcttgatatcgtttttcctccaggtgcggtacctcgtagttacaaggagaaatttgtgaacatcaaccacgaaaagcgattaaaagaagtgattatgatcgaaggaggatatttagacatgggatgcacatcttacctggacaggatccatgtagttgaaaaaacctctaaatcttgtatcattaaatcttctgttgtctatgaagtgaagcaagagtgtgttgaggcaatgtctaagttgatcacgacggaaccattgaagtcgatggcagaagttatctctaattacgctatgaagcaacaatctgtttctgagagaaacattcctaagaagcaatctctactgaggaaggaaattacttatgaaacggaggtgcaaacttctgctgattcaatttggaacgtctacagttctcctgacatccctcgactacttagagatgttctgcttcctggtgttttcgaaaagctagatgtcattgcaggcaatggtggagttggtacggtactggatattgccttccctctaggtatattaacaactattaaccattgcattttgcattttactatttgtgttattgtgttaggagtaattcaactaaccttccgcagtgagccagggcaattgactccacttgcccatagccttaccgactga

SEQ ID NO: 81 - DNA, 1041 bp, Papaver somniferum
atggaaacagtaagcaagattgatcaacaaaaccaagcaaaaatctggaaacaaatttacggtttcgcagaatcactagttctgaaatgtgcagtccaactagagattgctgaaacacttcacaacaatgtcaaacccatgtctttatccgaattggcatcgaaacttcccgttgctcaacccgttaacgaagaccgtctgttccgaatcatgcgttacttggttcacatggagctcttcaaaatagatgctaccacgcagaaatactcattagctccaccagctaagtatttgttgagaggctgggagaaatcaatggttgattcaattttatgcataaatgataaggatttcttagctccatggcaccatttaggcgacggtttgaccggtaactgtgacgcttttgagaaagcgttggggaagagtatttgggtgtatatgagtgaaaatcctgaaaagaatcaattgtttaatgcagcaatggcttgtgatactagattggttacttctgcattggctaatgagtgcaaaagtattttcagtgatggaatcagtacactggttgatgtcggcggtggtacgggtactgcagtgaaagccatatctaaagcttttccggatattaagtgcactatctatgatcttcctcatgtcatagctgattctcctgaaatccccaatatcactaaaatttctggagatatgttcaagtctattcctagtgctgatgccatcttcatgaagtgcatacttcacgactggaacgatgatgaatgcattcaaatcttgaagagatgcaaagaagcattaccaaaagttggcaaagttattatcgtggatgtcgtgatagacatggattcaactcatccatatgcaaaaattagactcacgctggatttggatatgatgcttaacactggtggaaaagagagaaccaaagaagaatggaagacactttttgatgccgctggttttgctagccacaaagtcactcagatatctgctgtccaatctgtaattgaggcttacccttattaa

SEQ ID NO: 82 - DNA, 1638 bp, Papaver somniferum
atggctgctggatatgctggtgtattggtttcagatccatggcttcaaaatcagttcactcaagttgaacttagaagcttaaaatctcattttttatcgatgagaagagagctgggaagtgtaacgttagaagatttaccatcaatgatgtcgaaactaaagattgttggagaaaatctgactgatgaagagagaagttcttttttggttgaatcaaatgggagtttgagtgaagaagttgattttgaaggatttcttaaggtgtatctgaaaatgcaagctcatacaaatgctaaaccaggtggtggtggtggtgcaaaggactcatctgcgtttctaaaggctgctactactacgttactgcatacaatcagtgaatctgaaaagtcatcatatgttgctcatattaacaattaccttggagaagatccatttttaaagaaatgccttcctatagatccattgtctaatgatctctttgaagttgtaaaggatggagttcttctatgtaaacttatcaatgtggcagtccctgggactatcgatgaacgggcaatcaatactaaaaggatacttaacccttgggaaaggaatgaaaatcatacactttgtctaaactctgccaaggctattggatgtacagtagttaacattggcacccaggattttattgaaggaaggcgtcatctggtgcttggagtgatttctcaaattatcaagatacaactactggcagaccttaacttgaagaaaacacctcagcttctagagttggttgaagatagtaaggatatggaagagctgatgggtctagcccctgagaagatattgctgaggtggatgaatttccacctgaagaaaacaagctacaaaaaaacagttacaaacttctcttcggatgtgaaggatggactggcttatgcacacttgctaaatgttcttgctccagagcatggtaacccatctatatttaccttaaaagattttctagagagagccagactaattcttcaacatgcggaccgaatgggttgcaagagatacttgacagcaaaagacatagtcgaggggtcgccaaatctaaacttagcatttgttgcacatgttttccagcacaggaatggtctcaaatcacaaacgaaggaaatatcttttattgaaacttctccagatgagtcccagatttccagagaagaaaaagcttttcgcctttggatcaatagtttgggtaattcgacatatattgacaatgtttttgaagatgttcgaaatggatgggtccttttagaggccttagacaaggtttctcctggtatagttaattggaagattgcaagcaaacctccaataaaaatgccgttcaggaaagtagaaaactgcaaccaagtagtgaagatcggtaaacagttaaagttttccctagtcaatgttgctgggaatgatattgtgcagggcaataagaagcttatattggctttcttgtggcaattgatgcgttgcaacattatccagctccttaaaaacttgagatctcactctcatgacaaggagataacagatgctgacattctgaactgggctaatgttaaagtgaagaatgcagggaaaaccagtcagatgaaaagttttaaggtatag

SEQ ID NO: 83 - DNA, 917 bp, Papaver somniferum
atgcagctaaaggaaaaggaagagctgttgagaaacatggagctcgggttgataccggaccaagagattagacaacggattagaatcgaattagaaaagcgtctccaatggggttacaaagaaacccatgaagaacagctttctcagcttcttgacttggttcactctttgaaaggtatgaaaatggcaactgagatggagaatttggatttaaaactatacgaagcacctatggaattcttaaagatccaacatggaagcaacatgaaacaaagtgcgggttactacactgatgaatcaacaacgttggacgaagctgagatagcgatgctggatttgtatatggagagggcacagatcaaagatggtcagagtgtacttgatttagggtgtggattgggtgctgtagctcttttcggggcaaacaaatttaagaaatgtcaatttactggagttacaagttctgtggaacaaaaagattacattgaaggaaaatgcaaggagcttaagttgaccaacgtcaaggttttattagctgatataacaacttacgaaactgaagaaagatttgatcggattttcgctgttgaattgattgagcatatgaagaactatcaattgcttcttaagaaaatatcagagtggatgaaagatgatggacttcttttcgttgaacatgtttgccataaaactcttgcttaccattatgagcccgttgatgcagaagattggtacactaattacatattccctgctggaactctgactctatcatctgcttcaatgcttctttactttcaagatgatgtttcagttgttaatcaatggactctgagtggaaagcattactctagatcccatgaagaatggttgaaaaacatggataaaaacattgttgaattcaaagaaataatgag

SEQ ID NO: 84 - DNA, 639 bp, Papaver somniferum
atggtgaagaagaaaacaaaggaacttcaattaaggagttcaacaccaaagaagctggctaaaacaccaccagagccaaccattactctgagaaaaagcccaagacttattgctaaagctaagaataatctgaattcaatatctataaaggtagtcctagattttgataatgatcctaagccaacacagccaactcaagcaagtgttggtgacaatttacatgtgggaggcagtcaaggcattgttgatctcgaaaatgatgaggaacaagctcctttctgtacaaaggcctcaacaaaagtcactaatttagaggaggcatttaaggcaatgcaggagtcagtttgtaatctagacaattggggagaggacgaatgtcatcctgaagatgcaccatggactcaaccacttttatatagtgaggatgaagatgctacggagtggtctgagttctgtaataactttaaggaagttggtcctggtggtccttctgtgcgaggtggccgatctgacaatggtgaccaagaaggcaatagtgaagacgatggatacgagcagttgttggagacggacgatgaagctgaagccaaccattgtgatcaatgctccgatactcatgaggaaaccgggaaggcctag

SEQ ID NO: 85 - DNA, 783 bp, Papaver somniferum
atggatattgtgaagtttcttcagccaaagttcactctcatggagaacgtagtagacatcatgagatttttgggtggaacgcttggtcggtatgccatgggaaggcttgtcgcaatgcagtaccaagttcgtcttggtttattgatagctggaagttatgggctaccacagtttcgtatgcgcacctttctttggggtgccaaaatgacagagcaaaatgttgtaaagggggatgaagagtatactctgaagctgaaggatgcattaattctgaaagatgcaatttttgatttgccaaagattacaacgcatgaagtcagggatgagatggactatggtaatcgtattcctaagacagattttcagaaaatgattcgcttgccaaatcacaagttgatggggtcagcttgcccagaggaatcagcgactttaaagctttttgaccacaggcctctgaaactaagcgaagatgataatcttcgggtttctaagatccccagggaaaagggcgcgaacttcagaaacctccctggagtgattgttgatgagaaaaacaaggcaagtcgtgatccgaagatggccaaagtaatgattggaaaatctggaaagccattggtacccgaatatgccataaaatttgtcaggggagcttacaaaaagccacttggaagactgtggtgggacgaaatcgtgtctaccgttgtgactcgtgccgagccacataaccagtggatggtttatgtaaacatcaattttctgacttttggggttttcgtcaaataa

SEQ ID NO: 86 - DNA, 819 bp, Papaver somniferum
atgaaggcagcaagactgattgtatttccaatcaaaggaaggaattggtgttttagtagatccattgaacaaacagttcaagaatcagaatcagcaaaaccatcaccaaaattcaaagatctttataagaaaattacttctaaggggaaacccatgaatcaaaatgttgagatcattactgaattcttctcaactaaaatgaataaagcttgggctggtcttggagaagctcctgaaggtagtatcaagaataagattcatggtttaggagtgaaactgctggctcgtgttaagccgtctgaaattttcttgaagtcgatttcaaaggatgttaccaatgtcgagattacttatccaacgagtttaaatcctcgtcttgtgcgccgaagattacgccatattgctttcaggggatctgtaattcacagacggtacttctatggttctgtttcgctgcttccactaactgctgcatgtgctattctaccactgcccaacatcccgttcttttggaccttattccgcacctattcccactggcgagctctccagggaagcgaaaggcttcttgttctagtatcagatggctcaactactgtaaaggagcagaaaagggacagtgatgatgaagacgagcaagaacataaaagcctgaatgcacctattccacaatgggttctgcatccctctgaagaccttgataagtatctccaggacctagatgaaaaagatggtctcagcaagtccgttgtttctaaaatttgcaaagcttatcatttggacacacaggaagttgataagtatcgttgttctatgtaa

SEQ ID NO: 87 - DNA, 1374 bp, Papaver somniferum
atgttgaaactaggatttacactgacttcctttacgtattcaagattcatatcttttctctgtaaggtgaagaatttcagtttcattgagagacttttagaagacatggatagatatggggctatacctgacatgtggagttacaatatatatgtaaacctcttgtgcaaggagaacgaattagacaaagctctggaagtaatgcagacaatgttacagaagggaagtgaccctgatgttgtcacttacacgacagtgctaaaagggttgtgtagtgatgggcgctatgaattggcagttaagctttggcgtgaaatgattggtagaggattgcttccggatgggataacatgtggggtgctggtttttggtttgtgtaaacgtggagaggttgatttggcttatgatcttactgtagactcaatgaagggaaaaaccccattgagtgtttcagtgtataacgcccttattcatggatattgtcagaaaggtgaggttaaaaaagcacaagcaattgaggaattcatgaggaagaacgggtgtgcgccggatatggttacttacaacatagaattgaattactgctgtaataacggaatgttagaagaggcggcgaaattgctaaagaagatggaaagaagtcagacgaaacccgatacatacagctacaaccaattccttaaggctctctgcaaagctaaccgtatggacagtgcatataatttgttggtgaaaacgatggagaagagaggtttatgtgatacagtatcttacaatactatgattagggcgtattgttgggcccgcgaaacccaaaaggcatacaggatgttcgaagagatgagtggaaaagggtttgaaccagatgttgtaacgtttacgattctcataaatgccttcttcaaaaagggccgtgctgatttagcagaggatcttcttgatcgaatgtcacaaaagggattatttcctgaccgagttttgtatactacaatgattgatcacctgtgcaagagcgggagagttgatcaagctcaaaactttttccgcgacatggaaagacttcgaatcactccggatgtaatttgttacaatgcccttataaatgggctcttcaaagcatttagggttgctgaaggcatgcaattttacgaagatatgcaacgtaatgggtgccatcctgacgaagtgacctataaattgataattggagggctcataagggaaaagaagcttacaatagcttgtaaagtgtgggaccagatgatggagaacggatttactcttgatgctgcactttccaagaccctaaccaatgccatccagtcaaaggatgcttcagtcatgaatatgtcgacaggtacaaatctattgtaa

SEQ ID NO: 88 - DNA, 306 bp, Papaver somniferum
atgaaatgggtagcttcgaaaagattggatttatgcaatattatggtggtaaggttttcaaaactctcatcactctattgtttcttttcttcaaacacttgtacattcaaacctaagctcagatttttcactagtaggaaaaattcgaataatcgtaatatgaaatcttcaaattttagctcagtgtgtagtcagaatggggtttcgaaaaaaactcaggtagcaaatcagttggaaacaagaaaaagatcgtcgggttcattcgaatgtgctttgagaatgcgcaagttacttaatcagtatgag

SEQ ID NO: 89 - DNA, 1746 bp, Papaver somniferum
atgcctttattagatattgctacatcacaacctactttcggaaatcatttttgcacttcttcgaggtatcagacattacttcatggtaatactacatctgttaaacttgttaattttggaaaggagaagagattgttttctacatgggaggtgtcaattcagctcccaacaaaagttagattcgatatgggtggtaatagacgaggaagagcactgctgattaaggcagttgctacactcgagcctaagtatttggttcagagtgaagatagaagtgcgaatttggaactgggttcagaggcggcttcgtctcagtatcccggtgaagaagacgaggccgaagtcgatgaaagagagagattaagacggttgagaatctccaaagcaaataaagggaatgttccgtggaacaaaggcaggaaacacagtgcagagactctacgccggatccgagaaagaaccaagattgctatgcaaaatcctaaggttaagatgaagttagtgaacctgggacatgctcagagtgaagagacaaggaacaaaattggggttggagtgcgaatggggtggcaacggcgccgtgagaagttgatggtgcaagaaacctgctgttttgagtggcaaaacttgattgcagacgcttctagaagaggatatgctggggaagcagagctgcagtgggagtcgtatgaagttttggatgaacagttgaagcgagagtggttggaaagcattgagcagaggagaatggcacctaggccgaaggggagtaagagggcacccaaatccctcgagcaaaggaggaaaatatcagaagcaatatctgccaagtgggctgatcctagttatcgtgagcgggtttgtgatgctctgaacaagtatcacggaatacctgaaggtagagagaggaagccaaggagaaagcctagtggagatagaaacgctgcgagaaagaaagcttatagtgaagctgagactgacgctaaacgccgagcgaaacctaagattaggaaaagtcgtgcagcaccgtacaaggatccattagcggattctaagttggagatgataaggaatatcagagcgcagagggctgttacagaaaccaagaaaacagaagctgtggaacgtgcaaagttattgattgcggaggctgagaaggctgccaaggccctagaggtggctgcaacaaagagtcctcttgcactagcttctcttatggaaaccaggaaactaattgctgaagcaactcgttcgatccaagctgcagagtctgggcagatttcatatcttggaaacaagaaggacagttctccttttgacttgaatgaagatctactcgaagatgaaacaggtgaaaaagatgaaaatatgccttcacctgaccagaaagaagtaaatggtactcatgtctactctgacgcgatatcagacttcgagtttggtaactttgatcttgaaggcctgctggatgatgacgaacttttggagatggaaggtctagatgatgatgacgatgatgatttcgtaccagctcaagtagaagtcaatggttacagtcacaagcttgatccaaaatctgaactagcagttcctgttgaagaaatgcaagaagctatcaagtctcaaagcaccgcgcaggaagtaccggtgagcaacaaggcagaaaagactagtgtgcgttctaacaacacaacagtcaagaagaaatggatccgtgggagactagttgaagtagaagaagactag

SEQ ID NO: 90 - DNA, 1074 bp, Papaver somniferum
atgggtagtttagatgcaaaaccagctgctgcaacacaagaagtttccatcaaagatcaagctcaactatggaatataatctatggttttgctgattctcttgttcttcgctgcgcggtagagattggaatcgcggatattatcaaaaacaatgatggggcaatcacacttgcacaacttgcggcgaaactcccaattacaaatgtcagttctgattacttgtacagaatggtaagatacttggtacacctgaatatcatagaacaagaaacttgtaacggcggagttgagaaggtttactcgcttaaaccggtcggtactctacttttaagagatgcagaaagaagtatggtgccgatgatactaggcatgactcaaaaagatttcatggtttcatggcatttcatgaaagaaggtttaggaaatggaagtacgactgcatttgagaaaggtatggggatggatatatggaagtatttagaaggtaatcctgatcagagccagttgtttaatgaaggaatggctggagaaacaagacttttaactaaaacgctgatcgaagattgtagagatacttttcaaggtttggattctcttgttgatattggtggaggaaatggtacgacaatcaaggcaatctatgaagcttttcctcatatcaaatgtacactttatgatcttcctcatgttgttgccaactctcatgatctccctaacatcgaaaaagttcccggtgatatgttcaagtctgttcccagtgctcaggctatcttactcaagttgattttgcatgactggactgatgaagagtgtgtcaacatcctaaagaagtgcaaagaagcaataccgaaagagacagggaaagtgattatagtggatgtagcacttgaagaagaatccaaccatgaacttacaaagacaagattgattcttgatattgacatgttggtaaatactggtggtagagagagaactgcagatgattgggaaaatttgctcaaacgtgcaggctttcggtctcataggataagacccattcgcgcaattcagtctgtcatcgaagccttcccttag

SEQ ID NO: 91 - DNA, 908 bp, Papaver somniferum
atgggtactttagatgcaaaaccagctgctgaaacacaagaagtttccatcaaagatcaagctcaactatggaatataatctatggttttgctgattctcttgttcttcgctgcgctgtggagattggaattgcggatattatcaaaaacaatgatggggcaatcacacttgcacaacttgcttcaaaactcccaattacaaatgtcagttctgattacttgtacagaattgtaagatacttggtacaccttaatatcttagaacaagaaacatgtaacggcggagttgagaaggtttactcgcttaaaccggttggtacgctacttttaagagatgcagaaagaagtatggtgccgatgatactaggcatgactcaaaaagatttcatggtttcatggcatttcatgaaagaaggtttaggaaatggaagtacgactgcatttgagaaaggaatgggaatggatatatggaagtatctagaaggtaaccctgatcaaagccagttgtttaatgaaggaatggctggagaaacaagactgttaactaaaactctaattgaagattgtagagatacttttcaaggtttggattctcttgttgatattggtggaggaaatggtacgacaatcaaggcaatctatgaagcttttcctcatatcaaatgtacactttatgatctaccacatgttgttgccaactctcatgatctccctaacatcgaaaaagttcccggtgatatgttcaagtctgttcccagtgctcaggctatcttactcaagttgattttgcacgactggactaatgaggagtgtgtcaacatcttaaagaagtgcaaagaagcaataccgaaagagacagggaaagtgattatagtggatgtagcacttgaagaagaatccaaccatga

SEQ ID NO: 92 - DNA, 1476 bp, Papaver somniferum
ttgagagaaaatatggagatcgtcacagtatcacttgtagcagttgtgatcactactttcttatacttaatcttcagagattcaagtcctaaaggtttgccaccaggtccaaaaccctggccaatagttggaaaccttcttcaacttggtgagaaacctcattctcagtttgctcagcttgctgaaacctatggtgatctcttttcactgaaactaggaagtgaaacggttgttgtagcttcaactccattagcagctagcgagattctaaagacgcatgatcgtgttctctctggtcgatacgtgtttcaaagtttccgggtaaaagaacatgtggagaactctattgtgtggtctgaatgtaatgaaacatggaagaaactgcggaaagtttgtagaacggaactttttacgcagaagatgattgaaagtcaagctgaagttagagaaagtaaggctatggaaatggtggagtatttgaagaaaaatgtaggaaatgaagtgaaaattgctgaagttgtatttgggacgttggtgaatatattcggtaacttgatattttcacaaaatattttcaagttgggtgatgaaagtagtggaagtgtagaaatgaaagaacatctatggagaatgctggaattggggaactcgacaaatccagctgattattttccatttttgggtaaattcgatttgtttggacaaagaaaagatgttgctgattgtctgcaagggatttatagtgtttggggtgctatgctcaaagaaagaaaaatagccaagcagcataacaacagcaagaagaatgattttgttgagattttgctcgattccggactcgatgaccagcagattaatgccttgctcatggaaatatttggtgcgggaacagagacaagtgcatctacaatagaatgggcgttgtctgagctcacaaaaaaccctcaagtaacagccaatatgcgattggaattgttatctgtggtagggaagaggccggttaaggaatccgacataccaaacatgccttatcttcaagcttttgttaaagaaactctacggcttcatccagcaactcctctgctgcttccacgtcgagcacttgagacgtgcaaagttttgaactatacgatcccgaaagagtgtcagattatggtgaacgcctggggcattggtcgggatccaaaaaggtggactgatccattgaagttttcaccagagaggttcttgaattcgagcattgatttcaaagggaacgacttcgagttgataccatttggtgcagggagaaggatatgtcctggtgtgcccttggcaactcaatttattagtcttattgtgcctactttggtacagaattttgattggggattaccgaagggaatggatcctagccaactgatcatggaagagaaatttgggttgacactgcaaaaggaaccacctctgtatattgttcctaaaactcgggattaa

SEQ ID NO: 93 - DNA, 1890 bp, Papaver somniferum
ctgattttatttgttgattttgtgatattattattattattattttttctaatggaggaagaagaacaaccaattgagatcagagctttgaaatcattaggtttagggttcgatttaacatctgattttagattaaagtttgctaaaaaaggaaacaaaggtgaagatgatggtattggtaggttgattgtgcttgatgaagaagatcaaagagatgttgttcttcctggtggtaaaattatatctggtgtatctagagatattaaatgtgataaaggagatcgtattaggtttaaatcagatgtggttgagtttaatcagatgtcagagttacttaatcagaagtctacagtgcaaggaaaaatcccttcagggtattttaattctatttttgattttagtggtctctggatggctgatgccacagacactaaatatcttgcctttgatggttacttcatctcactgtactatttgcacctaacgacatctccattagtgctccaagggagaataaaaaaggctgttccttctaactgggatcctgcatctctctccaggttcatccgtacatttgggactcacataattgtgggattggctattggaggtcaagatgtagtgtgtgtcagacagaaacattcttcctcaattcctcctgcggatcttaaacaatatttagaagaccttggagattcttggttttcagacggtggaagcacctctccattccgaagaactggagatgcaaaaagaaaggttccggaggtgttccagcgagttctgcagtcgaataggatgcaattgaacagaatcacagaaacatcaagcaaggatggactcactgttgtttgctcaaaaagaggaggggatgcttatttacatactcatcacaagtggctccaaacagtagcatcaaatcctgacgctatactctttaaatttgtacctattacgtctcttctttctggtataccaggcagtggctatcttagtcatgcgattaacttgtacctccgctataaacctgatccaaaggatttgcaatacttcctggagttccaagttccaaggcagtgggcacctatgtttaatgagctgcctcttgggcaccaaaggagggcctcttgtccttctttgcagttcagtttcatgggatcaaagcttcatgtcaactctacgcaggtctcaagtggcaggactcctgcggtaggtcttcgtctttacctagaagggaaggcatgcaaccgcttggccatacatgtacagcacctctcgaaccttccaaggttgcttgaatcttcatgggctggccccactacgctgaaacaatgtcaatggcgagggtctgatgaatccagtgtcccatacttagaacccataaaatggaaaagatactccaacatttgcacatcagtcgtaaaacatgatccaggttggttgcatggagaatcaccaggtgtattcattgtcactggagctcaactcatgaccaaggggaaatggccaaaacacattcttcaccttcgtttactctacacacatattcctggtttcagcatccagaaaacagaatgggcagttgcaccagcatcttcacaaaaatcaagtttcctcaccaatttcagcacaactttcacgacttcaggtccttcaaaggcagctcctgtggtagctataaattccggagtttattctgatggccctccaagaccagttcactctcaaaagcttcttaaatatgttgagacgtcagaaatagtccgggggccacacgatattcccggacactggatggtaattgctgctaagctagttacagaaggtggcaagattggtttacttgtaaaatttgcattgcttgattattccagtcccacgagtgagtag

SEQ ID NO: 94 - protein, 534 aa, Papaver somniferum
MMKKVIKYDMEVATSADSVWAVYSSPDIPRLLRDVLLPGVFEKLDVIEGNGGVGTVLDIVFPPGAVPRSYKEKFVNIDREKRLKEVIMIEGGYRDMGCTFYLDRIHVVEKTPSSCVIESSIVYEVKEEYADAVSKLITTEPLKSMAEVISNYVIQKESVSPRINILDKQSQVKKEIRYDLEVPTSADSIWSVYSCPDIPRLLRDVLLPGVFEKLDVIEGNGGVGTVLDIVFPPGAVPRSYKEKFVNINHEKRLKEVIMIEEGYLDMGCTSYLDRIHVVEKTSKSCIIKSSVVYEVKRECADAMSKLITTEPLKSMAEVISNYAIKQQSASERNIPKKQSALIRKEINYETEVQTSADSIWNVYSSPDIHRLLRDVLLPGVFEKLDVIAGNGGVGTVLDIAFPLGAVPRRYKEKFVKINHEKRLKEVVMIEGGYLDMGCTFYMDRIHVFEKTPNSCVIESSIIYEVKEEYAGKMAKLITTEPLESMAEVISGYVLKKRLQVFGFEIKPKLRFNLLLCLIICLAVAGGMFVAGFPL

SEQ ID NO: 95 - protein, 69 aa, Papaver somniferum
MRCLRRDNWTVVSSVCLFQNGLHYAPAARVPASGLVSHELASFSFSKRIVPGFDYQQQQYEEKKVNHKQ

SEQ ID NO: 96 - protein, 66 aa, Papaver somniferum
MGWPEPDAGFMDQRNEIPNDTNPHWASLIESSWHSDPKCRPTFKELLERLKDLQRHYFISKPKRTI

SEQ ID NO: 97 - protein, 169 aa, Papaver somniferum
MLIRRSKTTFFLDMDDDQDFNYKKPADTCKQTVRNSLISNEASSSASNSSVGLRILIHNHSTSPQESKNTVLVKHTFKLSLLASTYSQESSFLRSCCLCKKKLSPEKNVYMYMGDQGFCSVDCRSRQIVKDEIREIEISTKKILSSSPCCPKNVRIHLPSHRNRIPVAA

SEQ ID NO: 98 - protein, 148 aa, Papaver somniferum
MLRRTKSTLVLQDSFSSSLTKENSIFSQDSNNKPTFKLSEQGSFETSSPKMSSIFSQESSNFLKACGLCRKKLTPQKNIYMYRGDQAFCSDDCRCRKILIEELLMEETEEKTTMELVTKKEIAPSSVHFGRSLGNGLQPRRNHVRAAA

SEQ ID NO: 99 - protein, 613 aa, Papaver somniferum
MMKKVIKYDMEVATSADSVWAVYSSPDIPRLLRDVLLPGVFEKLDVIEGNGGVGTVLDIVFPPGAVPRSYKEKFVNIDREKRLKEVIMIEGGYRDMGCTFYLDRIHVVEKTKSSCVIESSIVYDVKEECADAMSKLITTEPLKSMAEVISNYVIQKESFSARNILSKQSVVKKEIRYDLEVPISADSIWSVYSCPDIPRLLRDVLLPGVFEKLDVIEGDGGVGTVLDIVFPPGAVPRSYKEKFVNIDREKRLKEVIMIEGGYLDMGCTFYLDRIHVVEKSLSSCVIESSIVYEVKEEYVDAMSKLITTEPLKSMAEVISNYVIQRESFSARNILNKNSLVKKEIRYDLEVPTSADSIWSVYSCPDIPRLLRDVLLPGVFQKLDVIEGNGGVGTVLDIVFPPGAVPRSYKEKFVNINHEKRLKEVIMIEGGYLDMGCTSYLDRIHVVEKTSKSCIIKSSVVYEVKQECVEAMSKLITTEPLKSMAEVISNYAMKQQSVSERNIPKKQSLLRKEITYETEVQTSADSIWNVYSSPDIPRLLRDVLLPGVFEKLDVIAGNGGVGTVLDIAFPLGILTTINHCILHFTICVIVLGVIQLTFRSEPGQLTPLAHSLTD

SEQ ID NO: 100 - protein, 346 aa, Papaver somniferum
METVSKIDQQNQAKIWKQIYGFAESLVLKCAVQLEIAETLHNNVKPMSLSELASKLPVAQPVNEDRLFRIMRYLVHMELFKIDATTQKYSLAPPAKYLLRGWEKSMVDSILCINDKDFLAPWHHLGDGLTGNCDAFEKALGKSIWVYMSENPEKNQLFNAAMACDTRLVTSALANECKSIFSDGISTLVDVGGGTGTAVKAISKAFPDIKCTIYDLPHVIADSPEIPNITKISGDMFKSIPSADAIFMKCILHDWNDDECIQILKRCKEALPKVGKVIIVDVVIDMDSTHPYAKIRLTLDLDMMLNTGGKERTKEEWKTLFDAAGFASHKVTQISAVQSVIEAYPY

SEQ ID NO: 101 - protein, 545 aa, Papaver somniferum
MAAGYAGVLVSDPWLQNQFTQVELRSLKSHFLSMRRELGSVTLEDLPSMMSKLKIVGENLTDEERSSFLVESNGSLSEEVDFEGFLKVYLKMQAHTNAKPGGGGGAKDSSAFLKAATTTLLHTISESEKSSYVAHINNYLGEDPFLKKCLPIDPLSNDLFEVVKDGVLLCKLINVAVPGTIDERAINTKRILNPWERNENHTLCLNSAKAIGCTVVNIGTQDFIEGRRHLVLGVISQIIKIQLLADLNLKKTPQLLELVEDSKDMEELMGLAPEKILLRWMNFHLKKTSYKKTVTNFSSDVKDGLAYAHLLNVLAPEHGNPSIFTLKDFLERARLILQHADRMGCKRYLTAKDIVEGSPNLNLAFVAHVFQHRNGLKSQTKEISFIETSPDESQISREEKAFRLWINSLGNSTYIDNVFEDVRNGWVLLEALDKVSPGIVNWKIASKPPIKMPFRKVENCNQVVKIGKQLKFSLVNVAGNDIVQGNKKLILAFLWQLMRCNIIQLLKNLRSHSHDKEITDADILNWANVKVKNAGKTSQMKSFKV

SEQ ID NO: 102 - protein, 305 aa, Papaver somniferum
MQLKEKEELLRNMELGLIPDQEIRQRIRIELEKRLQWGYKETHEEQLSQLLDLVHSLKGMKMATEMENLDLKLYEAPMEFLKIQHGSNMKQSAGYYTDESTTLDEAEIAMLDLYMERAQIKDGQSVLDLGCGLGAVALFGANKFKKCQFTGVTSSVEQKDYIEGKCKELKLTNVKVLLADITTYETEERFDRIFAVELIEHMKNYQLLLKKISEWMKDDGLLFVEHVCHKTLAYHYEPVDAEDWYTNYIFPAGTLTLSSASMLLYFQDDVSVVNQWTLSGKHYSRSHEEWLKNMDKNIVEFKEIM

SEQ ID NO: 103 - protein, 212 aa, Papaver somniferum
MVKKKTKELQLRSSTPKKLAKTPPEPTITLRKSPRLIAKAKNNLNSISIKVVLDFDNDPKPTQPTQASVGDNLHVGGSQGIVDLENDEEQAPFCTKASTKVTNLEEAFKAMQESVCNLDNWGEDECHPEDAPWTQPLLYSEDEDATEWSEFCNNFKEVGPGGPSVRGGRSDNGDQEGNSEDDGYEQLLETDDEAEANHCDQCSDTHEETGKA

SEQ ID NO: 104 - protein, 260 aa, Papaver somniferum
MDIVKFLQPKFTLMENVVDIMRFLGGTLGRYAMGRLVAMQYQVRLGLLIAGSYGLPQFRMRTFLWGAKMTEQNVVKGDEEYTLKLKDALILKDAIFDLPKITTHEVRDEMDYGNRIPKTDFQKMIRLPNHKLMGSACPEESATLKLFDHRPLKLSEDDNLRVSKIPREKGANFRNLPGVIVDEKNKASRDPKMAKVMIGKSGKPLVPEYAIKFVRGAYKKPLGRLWWDEIVSTVVTRAEPHNQWMVYVNINFLTFGVFVK

SEQ ID NO: 105 - protein, 272 aa, Papaver somniferum
MKAARLIVFPIKGRNWCFSRSIEQTVQESESAKPSPKFKDLYKKITSKGKPMNQNVEIITEFFSTKMNKAWAGLGEAPEGSIKNKIHGLGVKLLARVKPSEIFLKSISKDVTNVEITYPTSLNPRLVRRRLRHIAFRGSVIHRRYFYGSVSLLPLTAACAILPLPNIPFFWTLFRTYSHWRALQGSERLLVLVSDGSTTVKEQKRDSDDEDEQEHKSLNAPIPQWVLHPSEDLDKYLQDLDEKDGLSKSVVSKICKAYHLDTQEVDKYRCSM

SEQ ID NO: 106 - protein, 457 aa, Papaver somniferum
MLKLGFTLTSFTYSRFISFLCKVKNFSFIERLLEDMDRYGAIPDMWSYNIYVNLLCKENELDKALEVMQTMLQKGSDPDVVTYTTVLKGLCSDGRYELAVKLWREMIGRGLLPDGITCGVLVFGLCKRGEVDLAYDLTVDSMKGKTPLSVSVYNALIHGYCQKGEVKKAQAIEEFMRKNGCAPDMVTYNIELNYCCNNGMLEEAAKLLKKMERSQTKPDTYSYNQFLKALCKANRMDSAYNLLVKTMEKRGLCDTVSYNTMIRAYCWARETQKAYRMFEEMSGKGFEPDVVTFTILINAFFKKGRADLAEDLLDRMSQKGLFPDRVLYTTMIDHLCKSGRVDQAQNFFRDMERLRITPDVICYNALINGLFKAFRVAEGMQFYEDMQRNGCHPDEVTYKLIIGGLIREKKLTIACKVWDQMMENGFTLDAALSKTLTNAIQSKDASVMNMSTGTNLL

SEQ ID NO: 107 - protein, 102 aa, Papaver somniferum
MKWVASKRLDLCNIMVVRFSKLSSLYCFFSSNTCTFKPKLRFFTSRKNSNNRNMKSSNFSSVCSQNGVSKKTQVANQLETRKRSSGSFECALRMRKLLNQYE

SEQ ID NO: 108 - protein, 581 aa, Papaver somniferum
MPLLDIATSQPTFGNHFCTSSRYQTLLHGNTTSVKLVNFGKEKRLFSTWEVSIQLPTKVRFDMGGNRRGRALLIKAVATLEPKYLVQSEDRSANLELGSEAASSQYPGEEDEAEVDERERLRRLRISKANKGNVPWNKGRKHSAETLRRIRERTKIAMQNPKVKMKLVNLGHAQSEETRNKIGVGVRMGWQRRREKLMVQETCCFEWQNLIADASRRGYAGEAELQWESYEVLDEQLKREWLESIEQRRMAPRPKGSKRAPKSLEQRRKISEAISAKWADPSYRERVCDALNKYHGIPEGRERKPRRKPSGDRNAARKKAYSEAETDAKRRAKPKIRKSRAAPYKDPLADSKLEMIRNIRAQRAVTETKKTEAVERAKLLIAEAEKAAKALEVAATKSPLALASLMETRKLIAEATRSIQAAESGQISYLGNKKDSSPFDLNEDLLEDETGEKDENMPSPDQKEVNGTHVYSDAISDFEFGNFDLEGLLDDDELLEMEGLDDDDDDDFVPAQVEVNGYSHKLDPKSELAVPVEEMQEAIKSQSTAQEVPVSNKAEKTSVRSNNTTVKKKWIRGRLVEVEED

SEQ ID NO: 109 - protein, 357 aa, Papaver somniferum
MGSLDAKPAAATQEVSIKDQAQLWNIIYGFADSLVLRCAVEIGIADIIKNNDGAITLAQLAAKLPITNVSSDYLYRMVRYLVHLNIIEQETCNGGVEKVYSLKPVGTLLLRDAERSMVPMILGMTQKDFMVSWHFMKEGLGNGSTTAFEKGMGMDIWKYLEGNPDQSQLFNEGMAGETRLLTKTLIEDCRDTFQGLDSLVDIGGGNGTTIKAIYEAFPHIKCTLYDLPHVVANSHDLPNIEKVPGDMFKSVPSAQAILLKLILHDWTDEECVNILKKCKEAIPKETGKVIIVDVALEEESNHELTKTRLILDIDMLVNTGGRERTADDWENLLKRAGFRSHRIRPIRAIQSVIEAFP

SEQ ID NO: 110 - protein, 302 aa, Papaver somniferum
MGTLDAKPAAETQEVSIKDQAQLWNIIYGFADSLVLRCAVEIGIADIIKNNDGAITLAQLASKLPITNVSSDYLYRIVRYLVHLNILEQETCNGGVEKVYSLKPVGTLLLRDAERSMVPMILGMTQKDFMVSWHFMKEGLGNGSTTAFEKGMGMDIWKYLEGNPDQSQLFNEGMAGETRLLTKTLIEDCRDTFQGLDSLVDIGGGNGTTIKAIYEAFPHIKCTLYDLPHVVANSHDLPNIEKVPGDMFKSVPSAQAILLKLILHDWTNEECVNILKKCKEAIPKETGKVIIVDVALEEESNH

SEQ ID NO: 111 - protein, 491 aa, Papaver somniferum
MRENMEIVTVSLVAVVITTFLYLIFRDSSPKGLPPGPKPWPIVGNLLQLGEKPHSQFAQLAETYGDLFSLKLGSETVVVASTPLAASEILKTHDRVLSGRYVFQSFRVKEHVENSIVWSECNETWKKLRKVCRTELFTQKMIESQAEVRESKAMEMVEYLKKNVGNEVKIAEVVFGTLVNIFGNLIFSQNIFKLGDESSGSVEMKEHLWRMLELGNSTNPADYFPFLGKFDLFGQRKDVADCLQGIYSVWGAMLKERKIAKQHNNSKKNDFVEILLDSGLDDQQINALLMEIFGAGTETSASTIEWALSELTKNPQVTANMRLELLSVVGKRPVKESDIPNMPYLQAFVKETLRLHPATPLLLPRRALETCKVLNYTIPKECQIMVNAWGIGRDPKRWTDPLKFSPERFLNSSIDFKGNDFELIPFGAGRRICPGVPLATQFISLIVPTLVQNFDWGLPKGMDPSQLIMEEKFGLTLQKEPPLYIVPKTRD

SEQ ID NO: 112 - protein, 629 aa, Papaver somniferum
MILFVDFVILLLLLFFLMEEEEQPIEIRALKSLGLGFDLTSDFRLKFAKKGNKGEDDGIGRLIVLDEEDQRDVVLPGGKIISGVSRDIKCDKGDRIRFKSDVVEFNQMSELLNQKSTVQGKIPSGYFNSIFDFSGLWMADATDTKYLAFDGYFISLYYLHLTTSPLVLQGRIKKAVPSNWDPASLSRFIRTFGTHIIVGLAIGGQDVVCVRQKHSSSIPPADLKQYLEDLGDSWFSDGGSTSPFRRTGDAKRKVPEVFQRVLQSNRMQLNRITETSSKDGLTVVCSKRGGDAYLHTHHKWLQTVASNPDAILFKFVPITSLLSGIPGSGYLSHAINLYLRYKPDPKDLQYFLEFQVPRQWAPMFNELPLGHQRRASCPSLQFSFMGSKLHVNSTQVSSGRTPAVGLRLYLEGKACNRLAIHVQHLSNLPRLLESSWAGPTTLKQCQWRGSDESSVPYLEPIKWKRYSNICTSVVKHDPGWLHGESPGVFIVTGAQLMTKGKWPKHILHLRLLYTHIPGFSIQKTEWAVAPASSQKSSFLTNFSTTFTTSGPSKAAPVVAINSGVYSDGPPRPVHSQKLLKYVETSEIVRGPHDIPGHWMVIAAKLVTEGGKIGLLVKFALLDYSSPTSE

SEQ ID NO: 113 - DNA, 1200 bp, Papaver somniferum
atgaagggacatgataactccatgacaatgttgctcgtagatttttctaatgcatttaatttagttgatagatcaacgcttattagagaaggtagacatcgttgtccgagtattgccagttggattgagttttgttattctagtccggctagactctattataacgatgttgttctttcatctgcccaaggagttcaacagggtgacccactgggtccgctgttatttgccctagccttgcacccaattgcagagaatattaccacacagtgctcattagatctccatgcttggtacttagacgatggtactatcgtaggcgacactatggaggtatctaaggctcttaaaatcattcagacaaatggtcctgctcgaggtttacatgtgaacgttaccaagactgaagttttttggccctcattggatctcagaagagaccttgaagatgtattccctgtcaatataggtaaatcctcacgtggtgtgaagctattagggggacctgtcagtcttgatatgcagtattgtagtgaggttgttcagggaagagttgataaaactttgcacctttgggagaaagttcagaagctgtatgaccctcaaagtgagttgttactcttgcgcagttgcagtggtgtttccaagctttactttacgcttcaaaccaccgcccccttggatatacagtcttctgctattcactatgattcacaactcatgttatacttgcgtcaacttgtagtgggggatagtgctggttttggcttgcttcaacgacgtctagccacactgccaataaaagatggaggttttggaatatatactttgaatgacacatgtcagtactgtttcctagcctcttgtgcccagaaccagcatctacaacaatctatcttgaaacagtcatcagtcctagaccctagcttcagatttaaacatgctttgcagtcttttacccaagtttgtggtctatctgtctccggtttcagcatcaatgacgctgcccctcaatacatgaagaccctggcagtcatctactttggtgccgttaaagagaggataccaaccaacttttctcttacagaccgggatctgaccttatggcattgcaaccgcactcctcatgcaatggactttctaaaagccattcctatacatgggataaatcaagctattgctcctagacagtttcgataa

SEQ ID NO: 114 - DNA, 1446 bp, Papaver somniferum
atggctgttgctctgagatcaaaatcaataaaggaagcaactttaagaacaatagtcactcggtcaaggtactttgtatttgatcatatacataagattggtggaatatcaaatattcattacaccactagaagaaaacagtgggtagattatttggccaaaacgttttactgtttaaattcatttaaatcggcttctcttaaagctgaattcattgataagggtaatattattagtaccagtaatgttaaagttaatacagataatcgagaagttgggtcatcagattgtgatgagaatcgtgttaagcaaagtgagtttttgggcgaattttggtcttatagtgagcctcctgaaatttggcagcccaacggtgaaggtaatgtagttcattgggtaccccctaatgggaaacatggaggtggtagtggtggaggtggaggaccagattgtggaggtcagatgggctcgaattcaaaaaatgggtgttggggtggagcaaatatgggtaaggagataccttcacctaaagagatttgtaaaggtcttgataagtttgtgattgggcaacagcatgcaaagaaggtgctctctgtggcagtatacaaccactacaaaaggatatattgtgaatcttcccaaacacgaatctggagtgataggtctgcaagagattcaggcgatgaagctgatgagacagattttgattctgtggatcttgaaaaaagcaacgttcttttattgggtccaacaggctccgggaagacattacttgcaaaaaccttggcacgctttgtgaatgttccctttgtaattgctgatgcaactactttaactcaggcaggatatgtaggggaagatgtggaatccatattgcacaagcttttagtagttgctgactataatgtggcggccgcccaacagggcattgtctacattgatgaagttgataagatcactaaaaaggctgagagccttaacaatagcagggatgtttctggggaaggtgttcaacaggcgctgctgaaaatgctggaaggaacgatcatcaatgtacctgagaaaggagctcgaaagcatcctcgaggtgataatatccagattgacacgaaagatattcttttcatatgtgggggcgcatttactggcctagagaagacaatttccgaaagacaacacgattcctctattggatttggagaaccagtacgtgctaacatgaggagtggtggggtaatagatgctaccgtcacatcacatttgcttgaaacagttgaaagtagtgatcttgttgcatatggtttgataccggagtttgttggacggttcccagttcttgttagtttgtcggctctgaatgaggatcaacttattcaggtcctcacagagccaaaaaaatgccctaggaaagcaatacaaaaagatgtttcaaatgaacaatgttaa

SEQ ID NO: 115 - DNA, 1362 bp, Papaver somniferum
atgaatgcaagcgagtgttcgttgtcaactagggttttgtatcctcaatgcaacataaaccggccaagaacaaatataagttcaatttcatttccaaatcaatcaaaacagtttcatttcattagaagaaaacatcctcttttgcttcgttcattcggtgttattcgtaatgcaagctcagaaacaccttctgaatctgatactactagtaaacctagtggggacgattttataactagggttttgaaagaaaaccctagcttagtagaacccaagtatttagtagggaataaactttatactttgagagaaaaagaaatattgagtaataaagttcctaatgaaaggattttggaaattgcaaaacagttttgtgtgaaattaggatttaaaaaagatgaaatgggtgatgggaaccaacaattttctgattctgtgtatttaaaagatttattaagggaatataaagggaaactttatgttcctgaagatgtttttcatgagaatttatctgaagaagaggagttcaaaagggatttagagaatttgccgcaaatgagttttgaagaatttcaaaaggtttttaagactggtaaagtgaagctactgacttcaaaggctgattcaggaatttcgtataagtatgcatataaagattttattgtggacttgaaggaaattccgggtgataaaaatttgcagagaacaagatgggcaatgaggttaaacgagaatgaagcgaaatctgtctttgagcaattcaaaggcccacaatatgaaattgagcagcatttgacatcatacacaggaaggctacccgagtaccctcaccctgtagcctcttccatatctagcagaatgatggtggagctagggatgctaacagctgtcatggctactgcggcgactattgttggaggcttcctggcatcagctgtatttgccgtcacgagttttctatttttcatggctgtatatgttctctggcccctagcaaaaccaattctaaaactttccataggcctcatatctgccgttggagaaagaatctgggataatgttattgatactgttagtgaaggagggattttctcaaaattatctgaattctatacttttggcggcctgtcttccagtcttgaaatgatgaaaccaatctcattggtctttttgaccatggctcttcttatccgctttactctctcacggagaccaaagaacttcaaaaaatgggatatatggcaaggaattgaatttggacaatccaaaccacaggctcgtgttgatggttcaacaggagtcagttttaatgatgtagcggggatcgaagaagcagtagaggaactccaagaggtacactaa

SEQ ID NO: 116 - DNA, 1968 bp, Papaver somniferum
atggaagaagacagtgacggccgatcaggtaaagcgagaatgttaatagagaaagcaacaaattcagtagaaccagaagtcaatcctcgacttgtgaaagctattaaatttgtcgttcgttcttcagactccgaaattaaactagcagttgaaaccctaatggaaaatatgaaaaaaaatcactctcaggtgaggtatttagcgcttttcatagttgacgaattgttcatgcggtcgaagctgttcagatctctctttgttgtgaaatttgatctatttttgagtttgagtattggcttcagaagagatctgccacttcctgctcctgcacctattgctacccgtttacgctctaaagctactgagttcctggagaagtggaacacttcttttgggcttcattacagacaaattcgattggggtttgattatttaaaaaacaccctgaactttcagttccctaatcttcaggcaaatgcagctcggatacagcaagagagaagggaaagagagatcagatcaaaagagattttgttgaagaagtttgaaactttaagtcaaaatctctcatcgattaaggatgagattcaaataactgttgaagagataaggcagtgtttagacattcttcgtacgaatgaagctgatgacatcatgctggatacccccgaagaggatgaggttgaggatttcaggtgctcctccttaatggagattcgcctcgagtccttgagagaaagtgaaaagctacgtgagaccagcgagaataaggtgatatttgatgcattaagggaattgtacaagctcctaataacaaaacacttggtttcggtgcaagagtggatatctgttcttattagagttgaaccagaagacaccagtttcagagattccatgttaagagaattcatagatttacaaaatcatctcaagtcggtgagaaagacatgcgaaaattctggttgtgctcttacggattcaaaaaacgacaaggaagaggatttctgggaggagggtaaggtagaagtatgcggttatggaagtagcagcacgcctgcaaaggcaaacaaagatgctgcctgcatgtcggctgtcattacaaagtcaaatataacccctagacagattactgattctaatgccagcaagaggttagatggagaaggtgaagactctgagtcaaaccccctaaggagaaagcttctgtctgaagctccagtggtaaattggggatcttccttgtctaactggggatcaaactgggatgttttggctaaccaaagaggattagagcttgagggtcattggggtagggtagattatgatgcggttattccagcggaaaaaattgcggagttgaatgttcaagcaagtgtatacaaggaagagcatgttgatatccaaccgtgccttgctcctctgagaaaaggaggagtctgtcaaagaagagatttaaagatatgcccatttcatggacccgttatacctagagatgctgaaggaaacccaataaatcaagtttcattggcagaaaaggaaattaccaaaatggaaactgaagaggttattgctcgacaattagcagaacaggcagtgaagaatgttagggaaagagagaaagatgaagtaaagaagagagtgactgataggaagttgttgagccgtgcgaaacttgccaaggtgcgtgaacacaatgaagttgttctacgtgatgctgcagttgcgtcaacctcacgctctgcatttgttggacaagatggggaaacacaacatcagactacaagatcttctataaagggtaaaaaaccgtcactagcgtctatgctgcgtaagaaagtaacctcaaaagatagattgtcacagagacttttaaatacacgtgctacagatgctacagtaaggcagttaaccgttggtgaagattccaagtacagagaggcctatccaaatcaatggaagagaacatga

SEQ ID NO: 117 - DNA, 507 bp, Papaver somniferum
atggatcagatgggctatattgatcaaggattcagaggagacccgttcacctggacaaaaaaccaacaaggtcatgacaacatccaacaaagacttgatagagcagtaacaaatcaacattggagaacaaccaacccccatgctggaatcacacacctgccacgaatagcctcagatcatgctcctatcctgcttcaaacgaaagccttggactggcaaggaagtaagaattataaatttgagcatctatggctatctcaccctcaacttcatcaagtggttacctcggcatgggataaactacatgactcagatccacctttgaacctccagctcaaactcatctcagccagtgaaactctaacagaatggaataagattaactttggccatctacccactttaatcaaaaagtcaaccgcaaaaattaaagcttcccaacatcaatgtgctacgcaaactggagctgcgctggaaaactggattcaacaagaaaagcaactctga

SEQ ID NO: 118 - DNA, 1563 bp, Papaver somniferum
atggctttctcgtatacttgtttaggaggtgcaacactcagaaccctaaaattttcgtcatgttcttcaattttaagaccttctttacctcttttatctccaccagccaaaaccctaactttacattctcttcatcacttgaccaaaactcataaattccctccttttcttacgagagcagtttcagttccagcgggtcaaactctagacaaggaagaaactgccaaaccttatcaatggaaagctacaattgatttcaaatggattcgtgataataaagatgcagttgcttccaatattaagactcgaaattcggttgctgatttggaccttgttcttgatttgtacgagagatcactcaatcttcaaaaggaagttcaacggctccgaggggaaagaaatgttgttgctaataaaatgaaagggaaattagaaccgtcggaacgccaggaactcatagaagaaggaaaaattctgaaggaaggacttttgacattggaagaaaatcttcttaaacttacagagaagcttcagaaggaagcacaatgtataccaaatatggcacatccagatgttcctataggaggagaagattgttgtggactacgaaaaacggttggtagtccacgccagtttgattttcctgttaaggatcatgtacaacttgggaaagagctagatttgtttgattttgacgcagcctctgaggtcagcgggtcaaaattttactatctaaagaatgaagcagtaatgctggagatgggcctgacaaactgggcaattgctgaaaccatgaaaaggggttttacacctctaactaccccagagattgtacgctcgtctcttgtcgaaaaatgtggctttcaacctcgtggatcaaatacacaggtttattctatcgaggacagtgatcaatgccttatcggaactgcagagattccagttgggggtattcatatggattccattcttgccgattctcagttacccttaaaatatgttgcctactcacattgcttccgtactgaggctggtgcagctggttctgccacaaggggtctttatcgggtgcatcaattcagcaaggtagagatgttcatcttgtgccgaccagaggacagtgattcctttcaccaagagcttattgaaattgaggaggaccttttctcgtcacttgggcttcatttcaagaccttggatatggcaacaggggacttgggcgcacctgcctatcgcaaatttgatgttgaggcgtggatgccaggtctaggacgctatggcgagatttcgagtgcgtccaactgtacagactatcaaagccggcgtttgggtatccggtttcgaccttcaacagaacaaacctcatcaaattctaagaaggggaaggctaatgtaggcacaacccaatttgtacacacacttaatgctacagcatgtgcagttccaaggatgatagtatgcttattagaaaatttccagcaagaagatggctctgtagtgattcctgaaccactaagacccttcatgggtgggctcgaccaaatcagaccgaaaggacagtga

SEQ ID NO: 119 - DNA, 843 bp, Papaver somniferum
atggctaattcactattacaatcttcggttcttctctccaaattctcttcatcatcaccatcttcaacatcttcttcttcttgttctcttccatgtattagcaacataccctcaaaatcaacagttcagagaaagagaagtgtggttcttagagcagcaagtattgaaaaggctctaaatgatttgccagcagatgttgataaagtaattgacggtgttgaaaaggcacttacacctacctctgaaattaaggtcaaattgctgagtatcgttgcaggactgaataaaggacttgctgcgaatgcagaagatatggaaaaggcagatgctgctgccaaggaactcgaagctgcgggaggaactgttgacatctcagaagaccaagagaaattgcaagggagatggaaattagtatacagcagtggattctcatcgcgtactcttggtgggagccgtcctgggcctcccattggaagactactaccaataacacttggccaggttttccaaagaattgatgtcttcagcaaagattttgataacatagtggagcttcaattgggtgctccttggccgcttccaccaatagaagctacagccacattggaacacaagtttgaactcacaggatccaacaaggtgaaaataacattcgagaaaacgacggtgaagactaccgggaacttatcacagcttccactactcgaggtgcctcgaattccagattcatttaggccttcatctagaacaggcagtggtgaatttgaaattacatatctcgatgctgatactcgtatcacaaggggagatagaggtgaactgagggtgttcgtaaaggcataa

SEQ ID NO: 120 - DNA, 2763 bp, Papaver somniferum
gcaaacttggaaattgttcttttgtcatcgaatcagttcataggatctatctcaaagaatataggtaacatgacaaatcttagttcgttgtggttgaattccaataaattgtctgggagtgtaccttactcagttggtagttgcactaaattgactgagatatatttgaaggataacaatttcactggtgttctgccgaaaagtttgagtaatctaaagttgctgaatgtgtttgatgtgggttctaacagtctagaaggtggaatttctgaaggttttggtggtagtaattgcaagacattaagcacattggatttgtcttctaaccgttttgatggtgagattcctaatcagttgggaaattgtactagtttgcaagttttttcagtggcagataataaattaactggtggaatcccgtcatcgattggtttaatgactgaactcactgagctttatctttctgttaataatttatctgggaaaataccaactgagataggaaaatgtaggtccttgacagtgtttgaagctagttataaccagcttgaaggggaaattcctagtgagttggggctttgtagcaaattacagacactttttttgtatgtgaatatgttaactggagagatcccattgagtatttggaggattcaaactctagagaatgtaattgtttatagtaacagcctttctggtgaattacctgtagtgatgactgagcttcttcatttgaaaaatatctctctttttaataaccatttttccggcatcataccagaaaagttggggataaacagttctttattggagcttgatttcgtaaataacagcttctctggtgaaatcccaccgaatctgtgcttcggaagacaactgcaaattctgaatttgggactgaatcagctgcatggttacataccttctgatgtcggtagctgttcaactttggacaggttgaatcttaaacaaaataatctcaccggactccttccggattttgtagaaaattcaagcttgtctttcatggatatcagaggaaataattttagtggaaaacttccttcaagtttgggtaatcttattaagctgcaagttttagacctatctggtaacaatttgcaaggttcgttgcgtcaacaaatctcgaagtgtaccaaattgtattatcttgatgtgggtttcaacaaattgagtggtccgataccatctggtttaaggagcttgacactattatctaacttgaaacttcaggagaaccagttgaatggagaaattcctgatttctttccagagtttgaacatcttttggagttacaactgggtggaaatttgttcggaggttccatccctcgatcatttggcaggttgcatgactcggtatatgctttgaatttgtgtcgcaatgcacttacaggaaaaattcctgtagagttggggaagttgcgcaaactccagaaactggatatatctgtcaacaacatgacaggaagtgtggcaccaataggtgagctcctctcattaatcgaattgaatgtttcgtataattctttcagtggccagatatcacagacgctgatgaagttcttaaattcttctccgacttcgtttttgggaaatccaggcctttgtgttccttgtccactgggatccggcgtagcttgtactgagagtaacaacagtttgggtatctgtgatgatcgatcaagaagccgcaacaatcttagcaaggtcaggattgtaatcattgctattagctctgtatttgtcgttatagtggtggttcttgttttgggttgtatgtttctttccaaaagaaaacaagaaatgaaggatgaagtttctgatgaagatgatcaatcacctctaataagcaaaattatgaaagctacagagaatttgagtgagagatttgttataggaagaggagcacatggaattgtttacaaggcatccatcagtgaggagaatcactatgcagtgaagaagcttgattttgtaggccttaagggagcaagtgcaagtatgattcgagaaattgaaactgttggacaaataagacaccggaatttggtaaggttggaagaaatctgcatgagaaaggattatgggctgatcttgtacaggtacatgcagaatggtagtctatatgatgttttgcatgagattagcccgactcccgacatcacatgggatattcgctataagatagctctaggaaccgctgaaggattgtgttatcttcaccaggactgtcatcctgctattgtgcatcgagacatcaagcctaacaacatacttttagactcagaaatggaagcccatatctctgacttcggcattgcaaaactcatggatcaatcttccgcttccatccaatcaatctcgattgcgggtaccactggatacattgcaccagagagtgcatatacaatgataaggaaaccagaatcagatgtttacagttatggtgtagttctacttgaattaatatctagaaagaaggctttagatgcatcgtttccagaaggaattgatatcgtgaggtgggtgaactctacatggagtagtcagaaatccattgatatcattgttgattcaagcctcttggatgaaattgtggtttcctcactaactgaagaagttactaaagtactcttgttagctttacaatgtacacgaactgacccgaatgagagacctacgatgagagaggtagtgaagcagctagaagatgcaaataccaggtgggaaacaaaatga

SEQ ID NO: 121 - DNA, 1860 bp, Papaver somniferum
atgggtagtaaaaagagaagttctgaatcaagttctgatgatgaaataatggaagaatcagaagatctaattctcacttcagatgatgatgattctggtgatgaacaagaagaacctaaatccattactccaaaaccgaaaaagaaatcattggaaacaaaagaagatgttgcagaaccatcaccagcagctcctgtatctgtaaaacccatggaaaggagaaagaaaagaaagcaaatggataaagagagacacaaaactgaagaaaaaaaggtcaaagttcccaaagtgcaggcaaacactgatgcggccgttgcctcatcatcgagttcgaaaccagtgttccatataagtgtttttaatgatttagcatctgttggttcatcgattagagaagcagcaactgaaacattagttaaagagttgagagatgttcaaaaggagtataatttggtggagaagaaagggggtgatgatgggtctcaattagaagctgaaaagaaagatgggttggataattgtgcttcttctttgagatatgccattcgtcgtcttattcgtggagtttcttcttctagagagtgtgctagacaaggctttgcgctggggttgactgttgttcttaaaacaattcctgatgttaaattggatgcattgatgaagttaataacagatatactagaagttaattcatcaatgaagggacaggaagcaaaggactgtctattgggtcgactctttgcttatggtgctgttacaagatcaggacgtgtagctgaagaatggatctctaataacgatactccttgtgttaaagaatttactagcttggttattgctcttgcttctaagaaacggtacttgagggaaccagctgtctctctgattttggatttagctgaaaagttgcctgttgtagcattgtctagtcatgttgttgaagcgccaggcatgatggagtggttcaaacatgcaatggaggttggaaatcctgaagcattacttctagccttgaagctaagagaaaagatttcttcggacattgatgtattcggtggacttctgccacaaccatttagcccaaacaagatgtttaccgctgagcatctgaactctctcgtcccatgctttaaggaatcaaccttttgtcagcctcgaattcacagtctgtggtctgttttaataaatgtactcctcccagatacattaacacaagaggaagatgtaacttccagttcaagttccagcaaaaagcataaaaagagtcgcaagtctagttcttcagaggaagaggtcgtgaagaatcttcgatgtttttgcgagattgttatagaaggatctctgcttctatcttcccatgatcgaaaaaacttggctttcagtattgtgctacttctcttaccaaggttacctgcatcgtgtatccagattgtcttctctcataagctagtgcactgtttgatggatatcctctcaacccaaggttcctggctatataagagtgcacaatgttttttgaaggagatagctgattgggtgaagaatgatgatgatcgccgaattgcagttatcgtggccctacagaaacacagcaatggaagatttgattgcataaccagaactagaacagtcaaagatttggtcggagagttcaattcagaatctggttgcatggtgtttgtccaaaatttggttagcatgtttgtggatgaaggagcggcatcagaagaaccttcggaccagagccagacaacagatgacaattccgacatgggctcaattgaggatagagattctgctctaatgggggaccaagattctttaaagagttgggttgtagattctcttcctagggttatc

SEQ ID NO: 122 - DNA, 972 bp, Papaver somniferum
atgtttacaaagaccaaaaaatgttgtagtccccatgagaaaagttacccccaaaacaatcaagccgttggcgcaacaattttaattcttataaccatgttgttcatcgcaacatccgcaacaacatccatccctatatcatcgtcttccccttcatcttcttctatgatacgatttcaaaaaccactttctcaattacgtcgctctattaaattccattatcctcttatttctcctaaacatcttactaaatccctaccttgtcctctctggtcttcttctttctctttctgtcttcaacaactccacacatcatcaccatcttccttatctcgttcatctttttccgctgctgctcctttctgtactttttctccattaatggattctcagaatccatctccagtggtttcttctccacaggaagaagttgttgaattgaaagataatccgttgttgaaagattttgattttcctccttttgatgttgttgaagctaaacatgttcgtcctgcgattagagctatattgagtgagcttgagactgaattggttgaattagagaaatcagtagaaccaacatggccgaaattagtagatccattggagaagcttgtagatcggttacaagtagtgtggggagttgtgaatcatcttaagtctgttaaggattcagctgatctccgttccgctattgaagaagttcagccagagaaagttaaatttaatcttaggttgggacagagcaaacctatttataatgcattcaaagccattcgagagtcctcagattggcaaacattgagtgatgctcgtaaacgtattgttgaaggccaattaaaggaggctgttcttaatggtgtgtcgctggaagatgataaaagggaacagtttaataaagtgcaacaggagttagaaaagttatcccagaagtttgaggaaaacgttttggatgccacaaaaaaagtttga

SEQ ID NO: 123 - DNA, 579 bp, Papaver somniferum
ggagtgttgtaccaccagaatccagatgggtctctgtcaagatgtcttggagacgaggaagcgcaactacaacttagccgcattcacaacgaaatttgcggacaaacgttggtagtgactctttaccgacgtctccaacgccttggcttctactggccagatatggagactcaatatcgatcactccaagggtattactccaattgtcaaatacctccacaccaattggaggttttcaacgtgaaccacactggggactggcgaaagccgtatgtcaattaccttcgtgacggagtactccttgcaagcaaaaaggacgcagccaaaatgaagcaacgagccaagagattcgtatttcatggaggaatccagtatcgcaaaagctttggaggcgacctattacggtgcctggccgaagtggagatcccgattctgatgaaagaaatgcacgaaggcgaacaccggggaaggaagaagctatttctcgaagacgatactgctgcgtttttcaaagatgcaacgaatgtcaaatgcacggaaatcttattcatgcattttctacttctttacactcgatga

SEQ ID NO: 124 - DNA, 531 bp, Papaver somniferum
atgaggactggtgtcaccattattcacagatctttatcaacatcatcatcagcgcaatctttatctccatcaatagcagcagcaccaatccattcaccatggcattcaccaataccttatttatttggaggattagcagctatgttaggcttaatagcttttgctttgttaattcttgcttgttcttattggaaattgtctgcgtttttggacaatgatagtgaaagatcaagaaatgatttagaaaatggtgatggtgatgataaatcaactgatcaagaaaacattaaagtacatgtcgtttatgaagagaaaattgttgtgattatggctggtgatgttaaacctacttatttagctacacctattgattatcctaaaccaaatacaacttctgaaaattccaaaaatgaagatgagatgatgaactcattagatgaaaaaactaaagaagaagaaagtgatgtaagggtggaaacagaaagcagagaagccattgaaaacccacatcagcatcatcaaaaccactaa

SEQ ID NO: 125 - DNA, 1422 bp, Papaver somniferum
caggacttaaacgagaatgaaagagtttccgtagaagggatattggacaatgccgttacacaactaaaaatggttcagtctcatatgaagaagacacttgcagaaagcacgagtgctccctcactgaattttggagcaaagcaacaagatggaaagatggaggatatagtatgtcgtaagtgtgggaaatttaaaaagttgaagacagtaggagcggtggtgataaccgaactcgatgtcattagaaggcttaaagctgggtgtaatacaggaggtaatcaagttttatcccaggacagggatgaaatactgagtcgagccgtttggaggaagtttcagactcatcagagaacaactagtccacctttgctggttccaaaggttggatttggtggttctgaagaaatgatctcttgtccacgaagagagcagaagtatcggccaactgacggtgtaatgcagccaacattgatgaaatttgggccgagcggagtggaggcttatcccgatcaggataggactgcaaacagccgcagtcatcgaaacatagaatctactggatattcggccacatctgaagcctccttctcatctgcagactacagcgagtcgtattctagtagcgaagagtcagactcccctccgcaacatgcaatgcatttagaccgtcgtcgcagagatagatccatatctcggagtagatctcctcaatcccgctattcaggtagcagcagaagttatacatcatatgatgcatatgatagttacccggaggaggaatacccagttgcatataactatgattcatatgatagttccccggaggagtacccagttgcacgtggcaacaggagttatacatcatatgattcatataacagttccccggaggaggaatacccagtagcaaggaggagtcgatttcccaagaatgatccgccacagaagaagatgggacatgtcagaagattaaccaccaagctgggaggcatgttgcgtcgtgatcaccatggggattcatccaaggacgataagaatgcacgggatcatcatccttctgttcagaaacctgtaggtaatggtaaactccaccacgaaatcaaagggaaacacatgcctattcaaacgagaagaacggcaaaagttgaggaaaaggcaagccaccaacaaggtttcctaacacttgcaaaaagagtacgcgggcacgtttttgggtcgaagaaatcgaaaccgtcatcatctggcgtcagacggttagaaagagcagtaacaggtaaggaaaaagttactgctaaaaaacggcattggtggcacaaattgcgaaggcagggattacccaataaaaggggcaaggcaccccttaaactggggtttgagaataagcatacccagctaaagggccaacatagacataggaaataa

SEQ ID NO: 126 - DNA, 525 bp, Papaver somniferum
atgtttgcaacgatatgtaataataattatgaaagtctagttttaggtgaagacatcaatcactttgcaggattacgaaccatccgactacgacgacgattctacatcagcttgcttccacaacaacttgtacatataccatcctcagcttcagtaccaagtggaccctctcctcacagttaccttctccggcgggtatttagtttaccaactagggatgacgactgcgaggaaattttgggtagttatctccggcgggtacttcgtttaccaactagggatggcaaactctcggaactattgcggtcaaaaacttggctactcttatgggtagtctttcaaggtgagctagtaaccttagccttcaccttctaccactctcgaaagagtgttttaccacatctccaacaagcagctgacgcaggatttaagacgaagctgggtgggcaatacaaccaggcagtctcacatcaccaacaaactaccgaacctcctaatcaagttgtccaacgtgttactatgtag

SEQ ID NO: 127 - DNA, 654 bp, Papaver somniferum
atgggtatggtatttgggaaaattagtgtagagacagcaaaatatgaagttgttcaatcatcagaagattacgaaatccgaaaatacactccttgtgtggtagctgaagtggcttacgatccatcaaaatttggcggagaccgtgatggtggattcatggttcttgcaaattacatcggcgctgctggaaatcctcagaacactaaacctgaaaagatagctatgacggcaccagtcattactactcaaaaagcatcagaaaagattgcgatgacggctccagtcattactacacagagaacaccagaaactgttgatacgcatcaggaaaaaacaacaccaacatccatggttatgcagtttgtactgccgacgagcaagtacacgagcgttgagcaagcgccgaagcctacggatgaaagggttgtgataagagaggagggtgagaggaagtacgctgtggttaagttctcaggattaacaacggatcaattggtggaagaaaaggtgaagaagctgatggagagcttggagagagatggctgtaaggtaattactagggaaaatgaggataagttcttgttagctaggtacaatccaccatggacattacctatgttccgtacaaatgagattatgattcctgttgaatga

SEQ ID NO: 128 - DNA, 312 bp, Papaver somniferum
acctccatcattgattcgaatcaaatgaaaccttttgaacacattctcagttcatacttctcagaccaccagctgcaccatcacaaacacaccatctgtaatttcaatatcaccatcccagacaatattaactccatgttcatgtttctaaaatgcagcaccaccagaacctcaagccacaccaatacatcctccatttcaatatctagaccaactcggtgctctctaactgatggcatcaacagcatctgcatcttctttctaaccccactcagattcctctatctggttcaacggttccagttcttctga

SEQ ID NO: 129 - DNA, 732 bp, Papaver somniferum
atgaatctagccatgcttgcgaactggtgttggaggtttggccaggagaagaacaggctgtggtatagaattatagttgataaatacggtgataatttctcaatctggattccaaatcaagtcaaatctgcacacggtgtctcctgttggaaaacaatagcaactacagcctatttggtgagtacgaattcaagattaattatccattctggtgcaacgatgtccttctggaatgatatctggaggggaaattcttctatttcttcatcttttccagctctgtacaaaatctctacaaatagagacgcaaagatggttgaaatgatctctatggatggaagctggatgttcagttttaaacgtaatctctcgggttcagaagctaactcttttgcagaattgttgatgatgattggaaacaacccaccagctcttgatgaccttccagacacaaggcgttggtctttgcgcaactcgggaattttcacagtcaaatctctctattctaaactcattgcagactatggtgttcatgattttccccataactttgtatggaagaaacttatacctcctaaaatcaacttcctagtgtggtgtttaatccatgagaagctaaacaccattgacatgatgcaaataaagggtattgacatttataattcctgcgttctgtgcggtgatgacattgaatcaggatcacatcttcctgcactgcaaaatagctcatag

SEQ ID NO: 130 - DNA, 2723 bp, Papaver somniferum
atggaacaacttcgacctaatccactcataagaagatttgatcactcgacttctaataatttttattctccaagaaatgtgaggaggaaaacatttaatgaaagagttgataataccgaggctttgtttacttcgaaatcacttacggaagggaaatataggtaccgaaggggtgatgtttctgatatcattgactattccgtacctagtatgacggaacagttggatggggatagtatgtatgggagtgttacgaaagtgattcaagcgctttctgctaagagatgtgagattttgaattctctgcgtgagttgtatccatcactgcttagtcatctcgtgttttcagtaggaacgcctccgagaggtagcaggggaactagtaatgtggtatctcaaggtgttattgatttggatggtgaagatgagattcatgatttgggacctgtttctgatgaaagaatggaaacaccagctggtcagattgttttgcatacgccagggtgtaacaatgcaatggtgatggctggttcagaatcagatgaccgatatatgattggaaataacaaacctgattatagctatgaccttgaggtgtctaagatgagacgtgatcctaattactgcggtattcagatatctaccgatgcacaacgaataggatctcaagtgcggaccccataccatgtagagcagcggcagagaaggaattctactactcaaaatgataatcaggggattgcacctgttggagcacagatgagcactccatacgatttccagttgctctttccaaagaagccagttggtgaaaaaccagctaaacatgtaaatggaagtgatcagcgaaagaggaatgttgagaaagaagataaaggtgtttgtggcgaaacagtaattgagaaatcaaaaggagtatatgtaggtgtacaagatgatataatgagtgactcgggcagtggtggtgaagatgatgggcttggtgatatttggacggagatgaatctcgcattagaatgttccaaggatgcttcttcggctctgggtactgctatggaacacattgcagaagaggaggaggaagacgaatgtgagcattcttttgttctcaaagatgatctgggatacgtctgtaggatatgtggggtgattgaaaaaagcattgaacagatatttgacttccagtggggaaagggaaccaagactaccagaactagttacatgtctcaatatcgtacaacgaaggactgcgaacgagttgaaggatctcagtttactattgctaatgcatcggatcaagattttggtgtcgctgagatatcagtgcatccgaggcacatgaagcaaatgaagcctcaccaaattgaaggtttcaatttcttgcttaggaacttagtgtgcgacagtccaggtggttgcattttggcacatgccccagggtctggaaagacctttatgatcataagttttatgcaaagcttcctggcaaaatatccgaatgccagaccacttgtagtgttgcctaaaggaatcctgggtacttggaagagggagtttgaaagatggcaggttgaagaaattcccctgtatgacttgtatacttcaaaagccgatagtcgagcacaacagttggatgttttaaaacaatgggtggagcacaaaggaatcttgtttcttgggtataaacaatttgcaagcatcgtatctaacagtaccagtagcatagctgcagctgcctgccatgatatactcctgaaggttcctactatacttattttggatgaaggccacacgcctagaaacgagaccacggatgtgctctactccctttcacaggttcaaactcctcggaaggttgtattatctggaaccttattccagaatcatgtgaaagaggttttcaacattttgaatcttgtgcgcccaaaatttctgaagttagatacatcaaaggctgttgtgaggagggtcatgagtagggtgcagattgctgtcaggaagcaggttaagaatagtgggggagacacaatgttctatgatttagttgaagagaccctacaaaatgatcaagatttccgaaggaaagtcacagtgatacaagaccttcgtgagatgacaggcaaggttttacactactataaaggtgattttctggatgaacttccaggactcattgatctgactgtacttctcactcttaaccccaaacagaaacatgcagtagagaaattgagaaaattggataagttcaagagaagttccatggggagcgcagtctatgttcaccctcagttgaaagaacacgcagagagttccgccacaggagagaaaggacacattcacgaggccaagattgatgagcttcttaacaaagtagaactcaatgatggtgtgaaaacaaaatttttcttgactttattggcactttgtgaatctgctggtgagaaaatgttagttttcagtcaatatctcctcccactgaagtttttagagaggctagtggtgaaaactagaggctggagcctggggaaggaaatatttgtcatatcgggggactcaagccaggaccagagggaaatatcaatggaacgttttaataattccaaggatgcaaaagtcttctttggttcgataaaggcatgtggggaaggaatatctctagtgggggcatctcgcttactgattttagatattcatctcaatccctcggttacccgacaggc

SEQ ID NO: 131 - DNA, 434 bp, Papaver somniferum
atgaaccctgatgactattcatacatgcatcattcgccacaacgtgaaaatgaacattttgctagtgcctcactcacacaatcatctcttgtggatcaattagaagctcgaatcgcagctttagaaatgcaatcacatgaggaatctgtcacatctaattttcttaggcaacctgaaatctatgcatgtcccgcatgtggtagtttagaccaccctgttgagcattgtcatattttgcataattttaggcaatctagagaaaatccaaggtatgaaatgcccataaattgtgagaatggtagtcattgggaccataatcaatcctttgagggttgcgatcaatcttttataaaccctaatgaccatgcacacatgtaccattcaccacaatttgaacatgaagaattttgtactcccaggaatttagactccac

SEQ ID NO: 132 - DNA, 549 bp, Papaver somniferum
atgaaccctaatgactattcacacatgcatcatttgccacaacgtgaaaatgaacattttgctaatgcctcactcacacaatcatctcttgtggatcaattagaagctcgaatcgcagctttagaaatgcaatcacatgaggaatctgtcacatctaattttcttaggcaacctgaaatctatgcatgtcccgcatgtggtagtttagaccaccctgttgagaattgtcatattttgcataattttaggcaatctagagaaaatccaaggtatgaaatgcccataaattgtgagaatggtagtcattgggaccataatcaatcctttgagggttgcgatcaatattttgtaaaccctaatgaccatgcacgcatgtaccattcaccacaatttgaacatgaagaattttgtactcccatgaatttagactccaccacagaagctttaagactcagtaagcaaaaatttgatagatctacatcacgaattcatgcatatttagatcagattttgcttcacctacaaaaggaggaaattcatgaggaaatg

SEQ ID NO: 133 - DNA, 744 bp, Papaver somniferum
atggtcaactggatgctaataattccgtgcactatcgattccacaaccagtgaaaatcgaaatcttagattcacatgctacgaaacagacaacaatgttaaagacacttgtgaatatgatgggtttattgttgttttcgatcgaactaaactgtcatcctacaagtatgccaaaaatatttgccaccagcttgcagctaggctggtaggatataaaccagttgttttggtggccaataaaatcgatcgctttcaagagagcaggaaggcatatgaaatcgctgctgatcaagaattcggccacccatcgtgttttatatcagcaatgaataatactaatgttgagaagccgtgtctttctcttgcaagattgctaactaatgtacctaggttaatttttctacatgacatgcccattgctggtaaggttcctggtggaaacattgaagacccacccattcctgttgatattcctatcgccccatcattgtcgactgtgctcatgttaggttcatctgcatatgatcaagtccctgcacaaccatctcaacagattcagaccaccttgaaagttcttggtgatactcctgatgccccattaccatcgactgtccggcacttggatcgaacccctgaagtatcatcccgacagtctcgaaaaagcaccttgaggatcaatggcgtagattgtgcatctgtatcagaaattttagaagatcagcgctcaaagtgctgttactgttag

SEQ ID NO: 134 - DNA, 534 bp, Papaver somniferum
atggccagtagtcaaaaatcagtatgcatcatcaattctagtctactagttccattttttcttcatcttcttctcctacttacctcaacagaagctcgacaccttaagcaccgcgattctaattccacaggaaatgttcaagaagcacttctgaatggagatattaaagtgtcaggccctagccctggtggtgaaggtcacagtttcaaaaatgttgttcaaaccatgggaggaaataaggtggctggtccgagtcgtgggggtgaaggtcacaagtttaaaactcagcagctccgaacatttgggaggattaaggtgtcaggccctagccctggtcaaggccacaagttcaaaacacagcagctccaaacaattgggaggattaaggtgtcaggacctagccctggagaaggtcacaatttcaaaaatgttgttcaaaccatgggaggaaataaggtgtctggtcctagtccacgaggcggcggtggtcatcacaatagcgtgactaaaattcacaaatccaagcgagattaa

SEQ ID NO: 135 - DNA, 413 bp, Papaver somniferum
atgcaatttctaaagctcatccacagggcagagaagaagttggagtcgataattggggttatagaagcaaacaggattgagggagaaattaccagcaaaaactcgtcaattcaatcagaaaaggaagatgaatctctggatgagtttattattccttcttttttattctatgaagaaaatgatgatactcaaattatttccaaaactgaagtgattgatttcgacagagagaatcatgttcaaatggtggaggttagttatgagaaccttgaaagcataagggagttaatcattatccacagtgaattaaattgtaaggatttctttactcttctttttgattttgctcgttcattattcgatagaggaaaaaagatcgagctcagtttagagaattcttgttttactgattg

SEQ ID NO: 136 - DNA, 456 bp, Papaver somniferum
atgccatctcagcatgctatcacggagtatcgcctcgttcaatcttcagttcaaggtctaacatggatagaattgtccccgctcaccggtagaaagcaccagcttcgcgttcactgtgccgaggtcttggggacaccaatagttggagactacaaatacggttggcaagctcacaagaattggaaaggtcttccttggaccaacccaaaggagagatccgctgagaagcttcccaagatgcctctcttcgttcttgattctaagagtggaagcatctcagagaaggaacctcatttacaccttcactgcaggcagatgatttttccggatgtgcatatggccctgcaacatgttcactcggattctgatcttgatctgtcgacgctggagagcctcgattttgttgctcctttgcctgcacacatgcaaagaagctgggacatcttgaactcatag

SEQ ID NO: 137 - DNA, 744 bp, Papaver somniferum
atgcttcccacaacctcaaaagggcgcgcgtctaatgtgcgcccaaatccagtcttccctcaatacctgagaagaattgtcaagtggcgacaaatggatattgaatatacgttttggcaaatgctgaatctatgcacttctccaaaagttgtatatcagcacactaagtatcacaaacaaacaaagaaccaatgggcacgagacgatccagcattcattgttatttgcagcctccttttgattgttgcaacttcggcttactgtgctgcgttcagccatagcgtgggacatgctattagcacagttctttcagtattgatttttcatttcttaataactggagcgattctggcaacatgttgctggtttcttacaaattcatatcttcgcgaggagtctcctaacagtcatgtggttgaacaacgtgtggaatggctttatgcatttgatgttcactgcaactctttcttcccaatgttcgttctgctacatgtgattcactactttttatcacctctcttgattgcacacggtttcatcccagttctgctatcaaacttgcttttcatggttgcggtctcttactaccactatctcaactttctaggatatgatgtattacccttcttggaaagaaccacattctttttgtacccgatcggtattgtcatcatcctttcacccctcatgattctgagtggcttcaacccaacaagatacatgatgagcatgtatttcagctag

SEQ ID NO: 138 - DNA, 1074 bp, Papaver somniferum
atgggaagtgtaggaagcgagagaacaactacaggatgggcagcaacagacccatcagggatactctctccttacacttttgctcttcgggaaacaggtccagaagatgtatacatcaaggttacatactgtggagtctgtcacactgatattcatcaagtcaagaatgatcttggcatgtctaactaccccatggtccctgggcatgaaacagtaggagaagtaattgaggtaggaaaagatgtgacaaaattcaaagctggtgatagtgttggagttggattaatcattggaagttgcagagaatgttcatcatgtacctcaaacattgaacaatactgtaacaagaagatctggaattacaatgatgtctatactgatggtaaaccaactcaaggaggttttgcttctacaatggttattgatcagaaatttgtagtgaagataccagaaggattagcaccagaacaagcagcaccactcttatgtgcagggttgacagtttatagtccgttaagaaaatttgatttaacaacaagtggattaaaagctgggattctaggacttggtggtgttggacatatgggtgttaaaattgcaaaagcaatgggccatcatgtgactgtaataagttcatctaacaagaaacaagaagaagcgatggatcatcttggtgctgatgattacatcgttagctccgagcccgaacaaatgggaagagcagttgatactctagattatattatggataccattcctgttgttcatccacttgaaccttaccttcctttattgaaagtcgatggtagatttattatcatgggtgtcattgctcaacctctacaatttatcactcccatgataatgctcgggaggaaatcgattacggggacgtttatcgggagcgtggaagaatcggcggaaatgctcgacttctgcaaagaaaaaggtgtaacctcttctattgaattggtgaaaatggattacattaacaaagctatggaaaggttggagaagaatgatgttagatacaggtttgtcgtcgatgtggccggcagcaaaatcgatctctga

SEQ ID NO: 139 - DNA, 1800 bp, Papaver somniferum
atgaaaggtgattcaaaagaaaccttaattttgttgttcttcaatgcccctatctccttccatcttctcttctccttcttcaatgtttcctccactctcctagctaacttcttcttctcaatatatgaccacttaatcccaataaggtctacatgtaatgatgatgatgctgaatatcatgcatttcgtcatgaagaagaacatgatcatcattatgccggccaaaaaagagaatatggtcatggattctttagttttgatctgctcatggagcagaaagaggatcatttggtggctgatatcattcatggtggagaatccctcttatttatacctttccagagtcccaagaaagaacaggttgttttttacgaaggtatcggctgccaggagaaaataattctccaagaaaatggcgctgatgaagttgaagaacatcatattcatgattataccgttaaagaagatactgaagaagacgtcgccgccgaggactctacgtcatatcataatgaagacccaacaagtgatgatgatcaagaggaaattattatcatggaagaagaacattctccagactatttttctccacctgaagaatccgatgatcaagctagtgaactagatgtagcggtggatgttcttcaccaagacgaagagctatcattactaaaagatagtgatgctaattctgcaacaacgacaatggtgttcatcagtactgatcctagtgaaaatggttacatcgctccggtacaaatcgatctcaataatagtggtccggtacctaatgatgacacttcttcagaagaagaacgagatggcaaagaatctaaggacgtgaagattactatggagaccaaaatgttggaagacgggaagttttttgttttacaaaccaagaaaatccagaaaaatgtcgtcgaagatgatatgtttgaagattcattttcgaagaaaaatgacatgttcggagattcggttacagaaggatcgacgtccaaaagctcttcggaatggagaaactctgtcaattatagagactccggaacaggagatgatcctttttctacctcatctcggaggagttgtccaacatgggaatcttatacagttttcagaaaatatgatgaagagatgttgttcttggaccgtattagtgcacaaaagcttagtgaaacagaatctctacgagcaatagaagcatgtccaagatcaatctcgcagagaattgtgcatagattaacaacaaagaacaaacccaaataccaccagttcggccgatgtaacccgtatcaagaactagagacggcctatgtagctcaaatctgtttgacatgggaagctctcaattggaattacaaaaattaccaacgacttaaagcaacatatagtagcgaaaatgatcctggttgtcctggtcagattgcgcaacaatttcagcaatttcaagttttattacaacgatttattgagaatgaaccatatgaacatggtcgacggcctgaaatttatgctcgaatcaggaattcagcaccaaaactacttcaagtacctgaatttcgagaatcagaagaagataataataagaaagcaggttttatcaatatgacagtgtcatcgatcaagttttcaagagtaatggaagacgccattcgaactttcatgaaatttttaaaggaggataaagaaaaaccatgtgatatctttaaagcatttttcaaaagaaacagtagtcaaacagttgatccaacttatcttcatttaatgagaaaatcaaacaaaagggtaagtacttag

SEQ ID NO: 140 - DNA, 420 bp, Papaver somniferum
atggaaaaattgagtgtcttcttaatcactcctttagcttacgaagagggttgtgttggtgaagttttaaaggctattgagggcagctgtttgggcataagaggcttgatccttgtacggcggcctactgattctggttcttcgagtgaaattgacggtgatgaatatggtgttgccgtggttgctagtgctgtcaaatcatgcttaagaatcaagcccgggaatgccaagatgagtacgattaaaaatgagtatatgactgagtttaggattggcagcgactatcttcggaaaatcaagcagggtcaaggtcctcaaggactattggaagctactaaaaagtattcaaatatggtttcagtgtttggggatatcctccagatgacttgttgtatggttgtatgtttgaggcatcattag

SEQ ID NO: 141 - DNA, 783 bp, Papaver somniferum
atgcataagattcgtttggaggacgatgcaaagcctacaagggaagcgcaacgtcgtttgaaccctcccatgatggaagttgtgaaaaaggagatactcaagcttttggaagtgggtgttatctaccccatatccgatagcaagtgggtgagcccgatacaagtagtaccaaataaatcaggtgtaacagtggtggagaatgataagaacgaacttgtcccaactcgtgtgcaaaccggttggagggtttgtattgattacagaaaattgaatgccaccactaggaaggatcattttccattgccttttattgatcaaatgcttgaacgtttagctggacactcttactattgcttccttgatggctattcaggttacaatcagattatgatagcgccggaggatcaagagaaaaccactttcacttgtcctttcggtacttttgcttatagaaggatgccttttggcttgtgcaatgctccagctacctttcaaaggtgtatggtaagtattttttcagaatatgttgaaaacataatcgaagtgtttatggatgactttagtgtctttggtgattcatttgacctttgcttgcacaacttgtcattaatccttgaacgatgtgttgaaacaaatcttgtgctgaattgggaaaagtgtcattttatggtaactcatggcatcgttttaggccatataatatcttctaaaggcctggaagttgataaatctagattgaccttattcgtgctccaacccctcccactacggcgagggagatac

SEQ ID NO: 142 - DNA, 516 bp, Papaver somniferum
ttaaatgatgctcaacaaaactatacgaccactgaaaaagagttgttagaaatagtatttgcactggagaaatttcattcttatttgcttggtacaaaagttgttgtgttttctgaccatgcagcactaaggtacctactcataaagaaggaagctaaaccaaggctcattcgctggatattgcttttgcaagaatttgacatagagattaaagataagaaaggcattgataacacagttgcagatcacttgagtcatcttactgtagacgaagaaactatccggttgcgtgaaagttttccagacgagcaattgttctcactacaggttgtggagccatggtatgctgatattgtcaattatttggtttctaaaaaagtcccgaagaacttgtctcgtgctgagagagacaaacttaagagattagcttatcaatacatatgtgatgatccatataggtgctggaagttttcacctgtacattcaaatagttggtctaaaggcatgagtttttaa

SEQ ID NO: 143 - DNA, 660 bp, Papaver somniferum
atggatgccagtactccagcacatgcttctgcagcagaaaaggatctgttagtgtcctcgcgatcacattgcaggaaatcagtccaacaattccttggagaaggctcagtagctgatgttctgttatggaaaaaccaagctaccagtggtattctgctagtatcctcaagtatcatttggtttctttttgagatagctggatataatccgctactgttcttctcaaattttctgctgattctggttgttactctcttcttttgggggaaattggcttattttctcaactggcctcctccttcacttcccaatttgcaaatatctgatgattccatcctaaagatatccagtgatgtacatgttttaattaatcgtgtactggaaactggacacgctatcatcgtaggaggaaatgtgaaactcctattaaaggtcattgtttcgatctggattgttgcttttgttggaggcctctttaacttcatcactcttgtctatattggggttgttctttctctcactgtgcctgcattatacaacaattatcaagatcacatcgacgataagctatttgcagcacacgaagtggtatcggcacaactccgaaagttcaaattgaacatgttaaccattcaaagtgaagagaagaagcttcactag

SEQ ID NO: 144 - DNA, 531 bp, Papaver somniferum
atgatttcttctcttttcaatgtctctgctctcaaagctcatagcatagttttgataccgaaagatccaactgcagttactcctcatgccttgtttctcacttacaaagctgcaaatggaggtgaaccgatggatcctgaagtctatcctagacctacaggggaagtgtatgtatgtggaatgtcagcgaagggtgaagttccagataatccagaggaaataatgggagatccagaatcgattaaagtattgaaaagggttgctggaactgtatcaagtcatttgaaagaaggagaagttgaagtgaaagctgaacaagcatgttttttgccacttactgatgatgataagccagtaattggggaaatgccaaatgttaaaggatgttatgttgcaactggacatagttgttggggtatattgaatggacctgctactggtgctgctatggctgaacttgttcttgatggtgtctctagtattgttgatcttactccttttagtcctgctagatttgttaagaagtactag

SEQ ID NO: 145 - DNA, 594 bp, Papaver somniferum
atgtcatctggtgatggtccatcagtggaaggaaatacacagatcgtaacagtacctgagcgacctaaacattctcttccggctcttcccttggctccttcgaatgttggaaacgccattgtcgagtacaaaaaagcaaatccaaaagatgcagacgaggatattgaaatcaagcttagaaggattctggaacaagttcctgttcgtgttagcaatacgtctggtagttctgctggttctggctctggtgactttcatcagtaccggcaaatgaggcggaaagaacaagaccgacttgcaagaatgcgagtggactacgataaacgaaaagagctatctgattttatgattagaaaagaagaaagaatgaaggccgcagaggaaaggacagcaaaaaagcgattaaaacgtcagaagaagaaaatgaagaagcaatcgaagaagagtaggctgaaccctgatgcaggagagcaacagaaggacgaatcttcggaggacgaggataaatcagatgatgatgctggagagccagaaattccaaaacatatatttgttccagctgggaacagggggaagggagcaatcatcttgtga

SEQ ID NO: 146 - DNA, 1134 bp, Papaver somniferum
atgccgacaaccagatcatcatctggtagtattactccatcagcaagtatgcctaactattcaggagttggttctttggattcttcttcgacagaggcttctgcaagtccttatgtgcaacctccatgtaatgacaatgaatttgttggtgatgcagcatgtcactgcccttacaagcactttgaagattgtcaggatggtttaagtgggagaggttatgctaagacctctattcttaagcatataaaggataggcatttatctattgagaatggtatttctatatgtagggaaagaattcatgctatggcttatgtttacaggtcttgggaacgatttttgaaacaactgcagatgtggctatgctttccttgtatgcgttggtactcatggaaacgaccgtgtcgtgatcatggaggtagtattgttataaaaggtccatttaacggtagaagtgctgatttccttttatatggtgttgacaaacctacttccgctacatgtgacaccaataccaacttggacatacctacaagtagtgttgataattctttgtgtctttctgttaatttgctggacttggtgtttcagaaacagattgctgctatatcaagcattccaccactatgcaggctcaacttttctagaactttaaaggcttctcttgataaagttttgttccaacctaatgatttagattcatggttgcagttgcttctgcttcccacatgcaccctcaatatttatgtaccaaaaagctctatggaggagagatcaggcactaggagaaggctacaaacatcttcaatcaaccaggccctggctaagtggagagaaccaaatggatgcatcacattggtacaacaattattggagactaacaaggagattcagagtagcaggaaacttagcaagaagaagcaaaagcctgacattgaagattgcaaaaagaaactcaggtatgggcactataaagctgcaattaggatcctctcttctaatggtgtggcaccatataatcctgacacactacatgagcttcaactgaaacacccttatgctcctcctcccataatacctccagatataatattgatgttgcacctgtgtttgttgatgtcaaagctgttttga

SEQ ID NO: 147 - DNA, 627 bp, Papaver somniferum
atgattggggttttgatgaagaaaagagaccttcgattagcatcattctcaactccgacctacaggaaaagtgcagtttcagcatcaactccggcggctttgttaatatcggcgttgttcatcagctttggatatcctctggattttcaatcagggtttattcttgatctattttcaaccagatcaatttttatttcggctgttagaactagttctaggtgtttcaggtctgcaatggtggtttctttgatggcttatgtgttaatctttgtcatgagattctcatgttcgggtcactatgtgtttgatattagccccaaatgtggtaaagatctctgcaggaaggaacaacagctccatcgtttattccggcgagttccatatgttccggcaagcaaagtttctgttaaatcttacttggaaggtcttgggtttcagataaaaattaaaacttgttctagggtcgtggatcatgtctcaacgatccaagctcttccgtatatatgcgggtgttactgttactactattatgggtctctcctgtgtttaatcaggattactgctaccgatagagtcattcgtcagccgaatggattagctcggcttttgatatgtcgcagtcgatga

SEQ ID NO: 148 - DNA, 364 bp, Papaver somniferum
atgtggttgattattattaccttattgttatccttcactttagattgtgcattagaaagtagctgtttacagaatcccctggtgacaggaagattgaactgctttatagtgtactctcgaaactccatgactgccaccaagagtgctagaaaaacaaaaatcatatacttcgcaaatgaagattatgaagaaaaaaaacataaaaacatgaacaatatgatctgtatacaaaaaatttccatccatacatataaacttgccactcatatggaggaccataatcgcaacctttactgcttctatgaacaaattttaaagccacctctacggccccaaacctttgctctttcactacctcctgaca

SEQ ID NO: 149 - DNA, 1140 bp, Papaver somniferum
atgaaccatcatcagaatatggctggtggccaagttaatacgcatttttacgttgtgttcttcattatcttcttctgttgttgcagtgtcttagttcaatctcaagttccaaaaaacaaaactttcagaattataaaccaaggagactatcaaaatgtggtaagtgaatatgggtcgacttttcgttttgcaaaaccaaatgctaattttaatatggatccattcgggttatatttctacaataccactttcaatgcatatgttcttggaattggtggtggtagtccttatcaaaacatgatgttaagaaccgataaccaaattcattgggtttgggatgctaatcgcaacgacccagttcgagaaaaggctactctcactttcagtagaaatggtaacttagtccttgctgatgtcgatggtcgtatagtttggcaaacttacacagccaacaaaggtgttaccggaattatcatgagaaaatatgggaatttagtacttcatgacaaaaatgggaggtttgtttggcagagtttccagcatccaactgatacccttgttgcaggtcaatcacttcagctcaagggtaatagtataaaactcgttagtcgtacatcaaaccgcaacagttgtgatggtcgttatagtattgtgatcgatgacaaacacggattgacgatgtataaaaacacttcgggtaaacttgttcgatatgcaggttgggaagcaaagggtgtttctaatgtaacatttcattctgttacacgaattgatccggttcaaccagaaccgagtttcgaagaaaagggtaacacaagttatttcctatctctaggtttctctgtgggtaagaaagcaaaaactcactctaaaagagttatactcaaaataatggcgactacttttggtcactattcacatcttagattagaatcagatggaaacctaaaagtttatagctactctttacgacaaaattttccagaggaaagttcttggaaaaaagattatgcattcttcggagataccgtgaaagaatgtgcattaagatctaaatgtggaacatctgggaagtgctatgggagactgtgtagtgcttgccctcgtaaccgttcgtcaggttgcatgatcacttcatga

SEQ ID NO: 150 - DNA, 483 bp, Papaver somniferum
atggtccgtcaactaacagttcaccatcatgctggtggttgtttttctactgtcaacgttcctgtggtggcggttgcgttgtttgtatcggtaacagttcttgtaggtctatgtgccaagcacacaataaggcgacggcagcttgctagggagaaacttggctgtaatcctaatgattcaagagttacacccggttcatctccatccagaggacttttcgcaacgataagtaacaaagcttttcctttcatgagcaacaaaaaaagtggtgatcagcacggagacaattatgaaatcgttggtgatggtggtgtatggcaaagaggaatattgatgggtggaaaatgtcaaccacctgatttttccggtgttatttactacgacgttgctggtagacagctctctgaaataccgagatcacctcgtgctagtccgtttccgtctagcttctcatttccagctgcaaaagatggaaacttttag

SEQ ID NO: 151 - DNA, 411 bp, Papaver somniferum
atgaaaaagaagtcagtatctgccttatcttccaatttcatgctacaatcatgcatagtaaaaaaaaaggtatatttggtatacactagtatattcaccaagggccaggctcaccccaaaggcccatggggtgaaaaaaaggaagaaagaaaagtgaaacaacctattacctatccaaaaatgtatgatcaattacaaagattattgatctatcaaatcccaaaagaaaataccgcaatggatctgtgctgcggctctagttcgcaaaatggatttatgctgctactggaatacgatcccgatgagacggtagacgaattcgaacgtttttgggacagtacggagacgatgacaatattcttttggttgatgcttcaatttctctcatctcgtccttcacaatctgcttag

SEQ ID NO: 152 - DNA, 465 bp, Papaver somniferum
atgcttaagagaaccaaaagcaccttagttttgcaggattctttctcttcttccctggccaaaaaaaattctatcttttctcaagaatcaaacaataacaacaacttaacagtaggcaaacccactttcaaactgagcgaagaaggtttattcgaaccatcatcaaagatgtcctcaattttttctcaggaatcatcaaactttttgaaagcatgtggtctgtgcagaaaaaaattaactccacaaaagaatatttacatgtataggggtgaccaagccttttgcagtgacgattgccggtgccggaaaattttgatagaggaattactgatggaagaagtagaagaggagacgacaatggaattagttacaaaaagacagatatcatcatcttctgcacatttgggaacaaatattggaaatggtctacaaccacggcgaaatcatgttcgagctgcagcttaa

SEQ ID NO: 153 - DNA, 1245 bp, Papaver somniferum
atgccacttggagataaagctaattctgctgctaaatgggacagaattgtggagctttgtaaggcaagattagcctcttggaagcgaagaattctcactagggctggttggaggaatgtttgtaaaccgataaatattggtggcttgggtattagaagtttaaagcatctaaactgctctcttctccaaaaatggtggtggagacttggtaatgaacctaaagctctatggtcaagagttgttaaagacaaacatggtccggtagacttgggatggagaactcacaagcctaaggggaagcatggcatcagtttgtggaggaatatctactcaactgccgaagatttcttcaagctctgccaatttaagattggtaagggcgatagagtacgtttaggggaagataaatggtgcattcaaggtccactttatgcccttttccctagtctttacaacatttctagcaccaaaaatacttgtatcttcgcagcttatcatgatagtgcaaatggcttttattggatcttggggcttagtcatagaagacgtctgtatgataatgagatttctgaactttcagttatgttgcctttgctggagtcgattgtctttctacctaatgaagaggatcagttggtttggttgggtgacaagaaaggaatgtttactgtcaaggcggcgtatgcacatctttctcaaggtacaaaccctcctatttcttttcctagctctaaagtgtggtccagggcttggccacatcgtgttggtttctttctttggaaagtgtgcttgaatagactgcccactcttagtaatcttcatcataggcgtaccgcactgcactctcccagtctatgttatttgtgtggcattgccgaagaaaccgaagaccatttactcctgcaatgtcccttttccttgcgtgtttggaattactttattggtttggctggtggtgggaccttgcttcaaacggtgaaagatgtcattgtgggttggaaaaacttccccttttctgctcaaggtcttcaactgtggaaaagactccctgcagccattccgtgggctttatggaaagctcggaatgatatcgctttcgaaagaaaacctttcaaggtgaatgatgttattagaaacattaaaatggatgctttcaattggtctaggggtttagattgttttaagggtattaatacctctactgttattgttgggtgggcgcatttctttttaaatcctccctaa

SEQ ID NO: 154 - DNA, 1770 bp, Papaver somniferum
atggtggagacattgattggtaacaatagtatgactacttcaagagaaatgtttcggttcacaaaacagcttctgaaaggaagatggtttatgctatttgcagcttttctaatcatgtcaggtgctggtgcaacttatgcatttggcatttactcaaaggagattaaaagaacccttgggtttgatcaagaaactctcaatttacttggttttttcaaagatcttggtgctagtgttggtgtgttttctggtttaatagctgaagtaacaccaacttggttcgttcttctcgttggcgccgcattgaatttcttcggatacttcatgatttggcttgcagttgctggccatattgcaaaacccaaagtctggcaaatgtgtatgtacatttgtataggtgctaattcacagaattttgctaatactggttcattagtaccatgtgtgaagaattttccggaaagccgcggaatcatggtgggtttgttaaagggttttacaggattaagtggagctgtaatgaatcaactttatctagccatctatggtaataatcctaaagctcttattctacttattggttggcttcctgcagttgtttcactcttttttgtctacacaattagacccatgaaagtggtaaaacaaacgaatgaacggaaaatgttttacaaatacttgttcatatcgcttgcactagcgttattcgtaatggttataaccataatccagaaacaaaaggctttctctcatggtggatacattgctactgcaactgttgtttgcattttgctcttcattcctttaggagttgccatcaatgaggagcttgctatttggaagcaaaacaaacaagttcagaattcaactcctacttctgtaacaattgaaaccccaccagcaattgttgcccaaactgttgacgcaaagaaccccgtaccggaatcgtcttggtattcaaacattttcagtccaccgaaaagaggcgaagattacacgatattgcaagcgttactaagcttagacatgttactagtattcatttcagttttcagtggacttggtacaagtttaagtgcaattgataatttaggacagattggagaatctcttggctacccatctcttacaattagcacatttgtatctttagtcagtatatggaactactttggcagagtttgtgcaggttttatctctgaaatccttctatcaaaatggggttttccaagaacattagtaatgacagtagtcttagtcttatcatgtatcggcgacattctcattgcgtttgcatttccgggttctctttacgtttcttcggtgctcattggtttctcttatggtgctcaattaaccttagtttataccataatctctgaactcttcggtctcaagtattactcgacgttattcaactgcggtgttttgggcagtcctcttggttcgtacgtattcaatgtgagggttcttgggattctttacgatagagaagcactgaaacagttgaaatttaaaggactttgtagagattcagtgaaggaattaacttgtattggaaaagaatgctatagaatgtccttcattataatggcaggtgtatctttagttggagctttgtgctcacttgtgctggtcatgaggacaagagatttctatcaaggagatatttataagaagtttagagaacaggctagtggtaataagagtgaagaatcagagatgggtcttgctgtttcatctgttgatgaccggaaaacattaaaatga

SEQ ID NO: 155 - DNA, 873 bp, Papaver somniferum
atgtgcaattctgcagaaattgtggttttgagtaagaacactcactattgctttaatgatcttattgcgttttacctgatcatgttggacagagatacaaatcgtccccgaggttttggatttgtaacttttgctgatctacgtggaatggatgatgccatcagagagatgcatggcagggaacttggtgaacgtgttatatcagtcaacaaagcccagcctaggagtggtggtggaggaggtggtggtcgtgatgattatggtgggggatattcctcaggtggcagaggtggcagttttggtggtgataggagaggtccagggggatctgactgctttaagtgtgggcgaccagggcattgggctcgagaatgtccttcagctggtggaggaggtgcaggtggaggaggtgcagcacgttctagattcagtggtagtggcggcggccgtggagatcgctttggaggagatcgctttggaggagatcgctatggggatcgatacatggatgataggtatgatggtggacgttatggtgacagggatcgtgttgatagcagagacatcaagtatggagggcgtgatcgttatgctggtggggacaggtacccagctgctgggggagatcgatttggaggtagtgatcgttatggagcttcggatcggtaccctcagaatggctatagcaaagacagggcatatgatagagatgcagccccaaggactggttttggcgctgctggtgctggtagcgataggtatggaagtggagggccaacacgttacgagggaggaagctacagggacagggctggtccttacgatcgcccgagcaggggagcacgaccttcatcctacgaagaccgctactga

SEQ ID NO: 156 - DNA, 2325 bp, Papaver somniferum
atgggtgaaagtggtgatgtagctgctgcattatcagttgatagaagaagtgagctcaagagtccacccccatcaaaggtagcaccatggcttgtgattccatatggagaagaaggtatgacagaaaaccaagcattttataatatctgtgaacccaataaaaaaactcttagaaaatgtataccagaattgagtggaaaaacctttaagcagaaaacatctcatcaaggttggtgcattattgtatgtgatgatcctgatgttgattatgcaccagattggaattttggtgattgttttctttggaatcctgcaacattacagactattgaattgcctagtctactattttatatagataacgataaggaatttcatcataaagactgtgttttgtcctctcctcctagtggagaggatacagataatgattcaatggttctatttctttttgaacgaaaagataaacggtatgaccatgtacttatatattgcttccccggggacaaacaatggagaacacatacggtggctcgagatatggtagatttcgaggatgttacatcggtctgttattttaaagataaattctatgtaatgtgtgtgggagatcggcacatagaaattgaaatgcaaaaacttggggacattgttagcttctctataaggccaattgaggtacctgacaccatcttatggacaacagtaggaggaatagaaactactgttactggtacgcatttcgtggagtgtggtgatgagcttttcaggattgagataacttaccctgcaagaagaggatcaccgagagtagacatagcaatatatgtagcaaagtatgatttctctgttatggagttgaaggaggtgaccagttttggtgatcatgttctatttttaagtaacaatacctcatttagttgctcggcggctgagttgggactctccaagggttggttgttttacacactcgagcaggatcaaagtctgcacaaatatgaagtagaaagtaacggtaccactgttattttgccatgtctaaagctaccaaggccgtggtacacttctagctggattatggtacacgataaacatcatacaaaggaaaagatgtttggtagagacgaagaactgaaggcggtactggataataaaacaagtacaactggtagtgatagcaatgaggatcagagggaaacaaacggtagacgagaactacaagaagcaatcccttgggatattctttatgaggatatggtgcggttaatagcaaattatcttcaccggttggattatatacattttcgtcttgcctctaaagcaaatcgggtactaatgcctatggtaaagctggcatccacttgtactactagatgcacagatttatctccgtggttggttttctctcgggataaatgccaggaagtctacaattttgtgaacccgatgcataataacgagaactacctcatgaacttctctgatttagtaggtgctactatccgattccagaagggtggttggctactgatgtccaaggggtcagccagtatattcttttacaatcccttcacgaaagaaatcatcaatcttccagatttgccagtcgatacgttttccggcatctcattttcctcctcgccaacttcgtcagactgtatagtttttgcaattcaacaaatgcgtgtcagtgatggaatgtccaatgaaatcagcatttacttgatcaaaagaggagcaacgtcatggagttcctgtgactttcagaataaaaatgtggaaaagttcatgcctttgctcaacaccccagttttctataacggggtcttctattgcgtcgattacaacggaacgttgggagtttttaatttagaggatcataattggaaaattctggagaagccccttcagcaatttagtggtatatatccaagtttcttggtggagtgcgcaggacagattttattagtaagtttaggacaccttggcgcatcagttagagtatttagattggatttctctaaaatggtttgggatgaagttcgggatctgggaaagcacatgttgttcatcagctacacctcgtgtatctcagcaattgctctgaataggcgcatggagaacaaaacctatttccctagattatgtttgaacggcgaaggggttttattctattcacttgaaacaggtaattatcactctttcgggactcgccattctgctaataatttttatgatacagagggttggtatacaaactgtacctggattgaaccaaattggtcaaaagctcaagagctggactggcttaagcccctgttataa

SEQ ID NO: 157 - DNA, 1287 bp, Papaver somniferum
atgcgacttatgaatcaggttctccaaccctttctcagtaaatttgttattgtctattttgatgacatactaatttttagtcgcagtgagccagaacacctccaacatctttcacaagtgtttcaagttcttgctgacaactctttatatgttaatttgaagaagtgtaccttcatggcttcttcagtaacatttttgggatatgtgatttctactgatggtattcatgttgatccttctaaagttcaagcaattgaagattggccagttcctacttctattcgtgatgttcgtagttttcatggtttggcttcttgctatcgaagatttgtgaagaactttagctctatttctgcacctttgactgactgtctcaagaaggagaagtttgagtggacggaagcaatggataaaagctttattcttcttaaagaaaagctttttacgacaccaattcttgcacttccgaatttcaacaagccttttgaaatagattgtgatgcatttgttgttggtattggtgcagtattatcacaagagggtcatccaattgcatattacagtgagaagaattcagatgcacaaaagaaatggtctacatatgaattagagttattggctcttgttcaatctcttaagcagtggcatacttatcttatacatagggaatttgttgtcaacactgacaaccatgctttgaagtttttgaatacttctgctaaagttaacagaatgcatgatcgatggctttccacactcaacaaatacactttctccgtgagacataaaagtggcaaattgaatcaagttgctgatgccttaagtagaagaagtcatctattaactacaattcgtaatgagagttatgcatttgactatatcaaagacatttatccagaagatgaagattttggcaaactatgggatcaatgcagttctcaaactcatggggttgatgattttcttatacaagaaggttttctttttaaaggaaatcgattatgtattcctcaagggtctttacgtttacatcttatgcgagaattacatggcagtggtcttggtggtcattttgggagagataaaaccattgccctgattgaagaaagatatttctggccatctttgaaacgtgatgtacaaaagttcgtacaaaaatgcatggtctgtcagagagcaaagggtacaattcaaaataccgggttgtatactcctttaccagttcctgatgcaccttgggttgatataagtatggattttatacttggtttacctcgtactgcttga

SEQ ID NO: 158 - DNA, 2372 bp, Papaver somniferum
atgactgctcaaccagttactctagcagcaatcaaagctctcatcaaatctcataccgagattttggcaaaaaacattactgaagctcttgagaagtccatggaggacaaattagggttaagagataccaagcttgaaaccatgcagaatcaaattttgaaggttgcaaaacatataaatctagatttggaaatgcctgagcttgtagacttagaaggaaaaaataaagaagatatacttcagtttttacagaatgatgaagtacctgaagatgtattgcgtactttaaacattaagaaaccgtatgaaggtttcataggtcattcaaagaagaagatagtttctcctgcacttgacaatgatgatgaagatgaacgtgagaacgatctagagaagaattggactgaagaacgacgtttaaaaactggtcacaacccttacagttctttaccagaatataaactaaaagctaatattcccaacttctctggaaattttcgtattgaagaactaactgataggttctttgaggtagaagcttttttcgaattcatggaagtccctgaagattctaaggttaaacttgtgacatacaaactcaaaggaggagctgcagcttggtgggataagatctgtgatgatcgtagaaacgctaacaaaccgaaaatacgtacttggaaacgtatgaaaactttgatcaggtataagttcttacctagagactttatgcagcaacttttcatcaaattacaaaacattcagcagggggcacgaaccgttgaagaatatgtgtcagatttttataatttggtcgcacgaaatcaactcaaagaatctgaagaacagttagttgcaagattcattgagggactgaatagattaatacaaaatggtatgactcattcagtttttactatggtcgaagttgtgcagcaagctattaagatagaaaatcgtcttattcgttcttctaggatttatccatccagacaagggcgttatcaaaatacttacaggggtaccaattcatctcaaaacttttctccagatactgttttgaatattcccaggcctccttatgatgatgttagccattcacatcgacaacctagccatattgtgacttatactccacctctggctacacctatcttagccaattcagtcgatcttcagccgggtcagcagtctcactctctgcaaccaactcctcctactacagggaatcggtttcataacaggcaacaacaatttccaccgcaacaacgagctaataatgcttgtacaaaatttcgtggagataagtgcaataaatgtcagcaatcggggcacacttctagtgattgtcggaaattcaatgctttgattggtgaacctcagttcattaatgaagtcactggtgcgcttaatgagttcgaatatgaagactcacctggtgatgacgacgagtttgttgggatgattcgtccattatttcttactcaacaatgcaagtctcagagacacaatatttttaaatcaagatgttatattgggggtaaaatctgcaagatgataattgatagtggcagtgtgcataattgtattgctgatcacgtagttaagaagcttgaactaccagtaacttctcatccagaaccttacactgtaggatgggttaatgcctctagcacacagaagattactcttcagtgttatgtgtcattctcttttgagggttatgaagacacagttctatgtgatgtcattaatatgacggcaacccatcttcttcttggaagaccttggcaatacgatcttcaagcggttcacaatggattcgagaatacttacacttttgttcataatgggaaaaccaaggttcttagtccatccaattccacttcaaactcttgtgcgcagactgatgctgtcgtagccactgttattcgttctttgcacccacaacattctttacattcccatgaagattctaagcctatgattgagtttcctcctttacggaatattcaacactacatcgattttattcctggagcctctttaccaaaccaagcacactatctcttgagtcctgctgagcatgagatattacagggacaggtaaatgatttgcttaaaaagggtttgatacgacctagcaacagaccttgtgccagtcctgccttcttggttagtaaaaaagacaatggatggaggatgtgtatcgattgcagagcattaaatcgcatcaccattccttatagatttccgatcccgcgtattgatgatatgattgatttactttcgggctctattatttttactaagttggatttacgcagtggttaccaccaaatacgcattcgaggtggagatgagtggaaaacaac

SEQ ID NO: 159 - DNA, 378 bp, Papaver somniferum
atgaaagatctcggtaaagcaaggaaaattttgggcatggaaattgagagagataggagatcagacactattaatctttctcaaaaatcttatttgaaaaagctattcaagcgttttggtttagatgacaaggctaaaccagtaacacaacctctagctcgacactttaagttgaatgctgaacagtcaccaaaaacagtggaggagcagaggttaatggctgaaataccgtacacaagtgctgctggaagccttatgtatgctatggtatgcactaggcctgatatttcacaagctgttagtgtggttagtagatatatgcataatccagggaaggaacactggcaggatgtgaagtggattttgcggtatatttaa

SEQ ID NO: 160 - DNA, 399 bp, Papaver somniferum
atgttggaactgctgaaccagttggatggttttgattcaagaggagacgtcaaagttattcttgctacaaacagaattgaaagtctcgatcctgctttgctaagacctggacgaatagataggaaaatcgaattccctcttcctgacaccaaaacaaggagacgcattttccagatccacacttcaaggatgacattggcagatgatgttaacctagaagaatttgtgatgactaaagatgagttctctggagctgatattaaggctatatgtactgaagccggtttgcttgccttaagagaacgccgtatgaaggtgacgcatctggactttaagaaggcaaaggagaaggttatgtacaagaagaaagagggagtgcctgaaggactttacatgtaa

SEQ ID NO: 161 - DNA, 423 bp, Papaver somniferum
atggagagggcagagaaggagaagagtgtgagactaattaaggaattggaggatctgaaatgtgctaagaagagatctgatgatgaagttgaagagttgaaggtgaagtgcagagatttggagacccaagaaggtagattgagaaatcagattaggattcttgaggaggggaatggaaaaaagatggaaatggatcaaaagaagaagaaggtctgtgttgagataaatagggaggaggagttgaagattgaagatgatcctgagattggagttgttgcagagaggaaatgcatggaattggaagttcaaaaaacagtaaatacagtaatattacccatagatgtgattgagattgatagcgataatgaaattattgagattgatgataattcagatgataaaattcaaggaggaggtatataa

SEQ ID NO: 162 - DNA, 341 bp, Papaver somniferum
atgggtcaaggaacaccaggcggactgaacaaacagggaggaggtgcaccaggaggaaacgatggtgataacaacaagaaagagaagaagttcgaaccaccacctccaccaacaagaatcggtcgtaaacagcgaaagcaaagaggatcggaaacagcagcagcaagattacctgcagtgaaaccattaactaaatgtaaacttaggttattaaaacttgaaaggatacaagattgtttgttaatggaagaagaatttgtgtctaatcaagagatattgaaaccacatgaagataagaaccaagaagatagatctaaagttgatgatttaagaggttcacc

SEQ ID NO: 163 - DNA, 717 bp, Papaver somniferum
atggattttgacgaggagctgggagatgaaaagtttggagtttcaccaacgagctacgaatcatctcgaccaacaaaaatggtggcaaccggagaagtagtagcagtgtctacacgtaaatcagcttgtagatacagggagtgtttaaagaatcatgcagtaaatataggaggacacgcagtagatggatgtggagaatttatggcagcaggtgaagaaggttcactagatgcactgaagtgtgcagcttgcggttgtcataggaattttcatagaaaagaaattgaaggcgaaggttttcatcaccatccaagctttacaccttacagtagttatcgtgcaccgggtcatggtgatagcggtacttacttacacgtacccgctcgtccattagctttaccatcaacatctggtggtggagggaataacactagtagagatgatcaagatgaagataactcacaccctacaagtagtggtggattatcatcaaggaaaagattcagaacgaaatttagtcaagaacaaaaagataagatgttgagttttgctgagaaattaggttggagaatacaaaaacatgatgaagctgctgttcaacagttttgtaatgaaacttgtgtaaagagacatgtccttaaagtttggatgcataacaacaagcacactcttgctaaagggtgcatgatgatgatgatgatcaagcgaaggagctag

SEQ ID NO: 164 - DNA, 1509 bp, Papaver somniferum
atggctttacaagagcataatcaactccactttgttttatttcctccaatggcacagggtcacctgatccccactatagacatggctagactctttgctgagagaggtattaccgtcaccataatcaccactcctttgaacaccttcaggttcaaaacaatcatagatcgtgctgttgattctggcttttcaatcagacttctgcaactcaggttcccttctgtagaagcaggattgccggaagggtgtgagaatgtggactctcttccttcacgtgaaatggtgagtaatttctttaaagccacgtctgtgttacaagaaccacttgaacagttgcttggagtgctgaaacctgttccaagctgcataatttcggccatcgctttcccatggactgcggagacagctcgtaaactgcaaattccgagacttgttttccatggtacgtgttgtttttctttgttgtgttgccataacatactagaatacaaggttgctgatagcatcacaagcgagtccgagtcgtttgtaataccgggtttgcctgatcgaattgagataatcaaagcaatgctcccaggaaaccttcctcaaagctcaggtgacctgaagaatttccgtgaccaaattaacgcggctgagctgactgcgcatggtgtagtggtaaacagttttaacgaattggagcctatgtatgcggaagagtatctgaaagcgaagttcggaaaagtttggtgtactggtccagtatctctgtgtaacaaagagacattagacaatgccgagagaggtaataaagcctcggtggatgaaagccaatgtctgaaatggcttgacttgaaagaccccggatcggttctttatgtttgtctgggaagtctatgtcgattaacaacttcagaaatgatcgagcttgggttgggtctagaagcatcaaagcatccctttatatgggtgatcagaggcagagataagtacctagatttagaaaaatggttacttgaagagaaattcgaggaaagaaacaaagatagaggtctcgtaatcaagggctgggcaccacaaatactaattttgtcgcacaaagcaataggaggattcttaacgcattgtggttggaattcagtacttgagggagtttgtgcgggtgttccgatgataacatggcctatgggtgaagaacaattctttaatgagaaattggttgttcaagttttgggaattggagtgaagataagaggagatgatattcatgctagtgatgctacgaaaccaatggaacttatggaagaacacaggaagtttggaagtgatgaaaataagagggaagaggtggagaaggctgtgaacagagtaatggatggaggtggagaaggagaagagagaagaagaaaagtgagagaacttggagagagagcaaagaaggccatggaaggtgggggatcatctcaactcaatatgacactattcattcaagatatacagcagcaaggaccaaaacaaggataa

SEQ ID NO: 165 - DNA, 540 bp, Papaver somniferum
cccccaccgcccgccggaaaagaaaaggggagtatttctagagaaaaagaagaagagatgagcagtagaggaggaggaggttcaagtagtagtagtagacagaatgtaaattcagtgttttatgcagaatcgtatcatccaattcaagctggtagtattgatggaatagacattcttcctcatgataatgctgtttacagagctctcctttgttcttcagctggactctatgacccatttggtgaccctaaggttaccggagacccttattgcagtttgtttgttgggcgtctatctcacctcactactgaagattcacttcataaggcaatgagtaggtatgggcgagtcaagagtttgcgattagttcgtgacattgtaactggtgcttctcggggttatgcatttgttgaatatgaaaacgatagagagatgaggcgcgcatatgaggaagctcaccattctagagttgacgattgtgaaattttagtagattataaccgacagcagttgatgccaggtggataccacaaagattag

SEQ ID NO: 166 - DNA, 747 bp, Papaver somniferum
atggttcccgtaaacaaaaatctaaatcaaaatcaatcgaagaaagagacgaaccctaatcaaccgagcacgagttcggatacagaagatcgaagtaaccctaaccctaataacaacccagcagtgacagtggaatcgacatcaagtgtatctccattagtgatagaaggggatgaagaagatacaatcttgaagaaatcagagtatttgactagagaagaagttattaggaggagattaagaagggttagacaaatggagaagctttataaagatcattattggtctttaatggaagaacttagggttaaatatagagagtattattgggaatatgggaagagtccttttaaggaagaagaaactagagaaagggggggaaatcatcataacaataacggtaatgggggtttggcaaatggtgggggtgttgttgttgaaggaagtggtgataatcataataatgtcaatggtggtgttggtggcggcggtggtagtggtagtggtggtgctaaattagggctagtgaatgggggagaagataataatgatgggaaatataaaagatgtgtttttgttggatgtaaatctaaacctatggcacttgctaaccattgtcatcaacatattattttggattcaagacagacactctacaaaacttgcaattatgtcactaaaaggtttgatttttgttcccttttgtcttttgattcttgtttatttttttggggattttggggttaa

SEQ ID NO: 167 - DNA, 1653 bp, Papaver somniferum
atgctctgttctacaaagaagcagggcatggaacgccttattgttgtatgtttatgtgtttcactcctctcaatctttgctcttgctgatccaggagcagttggagttaattatggaagaatagcaaacgacttaccatcagcagtaaaaacagtagagcttctaaaatcacaaggaattgataaagttaagatatatgatactgattccgcagttctaaaggctctatcaggttcaagcatcaaagtaattgtttcattaccaaatgaaaatctaacagctgcagcaaaatacccatcttttgctctctcatgggtacaaaaaaacattgttccatactacccattaacccaaatccatgccattgcagtaggaaatgaagtttttgtagatccaaataacacaacagatgtcttagtacccgctatgaaaaacgttcaatcagctcttgttttttacaaactagattctggtatcaaaatttcatcaccatttgctttgagtgcattgcaatcttcattcccagcttcatcaggctcattcaaaactgaattaatcgagccagttattaaacccatgttcaatttccttcgagaaactaaatcttacctcatgttaaatgcttacccattctttgcttactcagctaatgctgatgttatatctttagattatgctctgttccgtgaaaacccaggtgtagttgattcaggaaatgggttaaaatatactaatctttttgatgctcaagtggatgctgtttatgctgccatcaaagctttgaaatatgatgatgttgatatcgttgttactgaaactggttggccgtctaatggtgataaagaagaaatcggtgctaatccagaaaatgcacaagcttataacggaaacctagtgaaaagagtactaactggtggtggaactccattgaaatcagaaacaaagcttgttgtttatttgtttgctctgtataatgagaacaagaaatttggtccaacttcagagcgaaattacggtcttttctatcccagtgaagaaaaagtttacgagataccatttacattggaacaagtcaagacatggaagttaaagccagccagtgatcgtaaagctcaatctcaggcacctgcaaagcctgtttacagtggtgagtctgccggaagtaatggaacaagtggggtttcgaattcgtcctctgcaaagggtccattttgtgttgcgaatgtgaaatcagggaaggaaagattacagaaggctttagattatgcttgcggtgctgaaggtggcgctgattgtcgttcgattcaacctggagctgcatgttatgatcctaacacactgggtgcacatgccacgatagctttcgactcgtattatcagaacaaaggacgtgctaattcagcttgttatttcggtggtgctgcttacgttgttactgtacctccaaagttaggcaagtgtgatctgactatggatagtgaagaagataacggtaccaaaggagctgggaaattgttcgtgcagaccaataataaagagaacgccgaggctgttgaagtgagcttatcaagccctagattagtgacattgttaggtagtggtacttttgatattagttgggtattgttagttttaatgtatttatcgttttaa

SEQ ID NO: 168 - DNA, 393 bp, Papaver somniferum
gattcattggttttggtttatctctcttattgtttccttaattttgtgccgcaagaattaatgggtctactgtttaatggaaaaatggaaagcattctgagaaagataaatccatggccgtggttgcccagaccaaaccccttttctgaacatgtgcctgaatttttagggagacgaatcagtaaccttgggctctcaatcgttctctacagctaccctaaatcctctaccctggaattcttctacttcctgccttcaaggaagaaccttactgaaaccttaaaaatttcaggaaagatcgtgaagtctccattatctaccattgtgagttacccaagaccttcattatttttaggtaatcagtcccatcacaaaataaaaaaacaaagatag

SEQ ID NO: 169 - DNA, 360 bp, Papaver somniferum
atgaaaactttgatgcagtttatgaacttgcggacgcatctgaaactgggaaaatataaaggtaatctcattctttccactaggcttttatccgattttgatttgtcatcgggtaatatttttagtgcaaccaagaaaatggcgacgagtaaatccatactcgaaattgcattaaggactctgtaccttctcatatgtgtctttcaaaagatttttcatgaacttctcactttgtgtcaatttttacatctctgcaggatctatcaggttgaaattggattgattaatcttccggagaatgtagtgggttctttgtactttttttttttattttatataatccatgttttttccttttga

SEQ ID NO: 170 - DNA, 789 bp, Papaver somniferum
atgatttggaatccgtttacaaaagattacaggaaattatcaacaccacccaaaccagatttggatccaagttatgtatatgacttctattcctattctaagtatgggttcggttatgattcgaaaacagatgattataagtttgcaaggatggtgaaatgtccgggaagttctactgaaatcagtgtctattcactgaaactaaatttgtggaagacatatcgagacatcccttttctattgccttttaatggtggcctagtgctttttcaaggaatttttcattgggtgggagacagatcaagaaatatcgagatatctcgcgacttccctcgggggtttaaactccctaaaatcattggctgtttggatactggtagcgagacattcaaagaaattccactaccacaacattttgcagagttatttgggatatttgtttgtgttttgggaggtttcctttacataattggttttcggtatgtgaacattggtagcgaggcgtggatgatgaaagattatggtgtgcacgagtcttggacaaaaatgttcaatatccgtgaaacaagtagtaaccttgttggagctgggtgtttgaatctgaagcattacttcaagagtggtgtgattttggtacaggtggataacggtcgttgtttattgtttgatctcaaaaataaaaagcttacgaaacttgagatcagtgaccatacattgttctacacatgggcttttttggggagtttagtttcacctaataatttggatacatgtttggggatgcagtag

SEQ ID NO: 171 - DNA, 1299 bp, Papaver somniferum
atgtctgatttggatttatctactgatagtgaagatgaagcctttgatacagaagaagaaagcagtgatgatgaagaggtaagcagcaataatgaatttgaactatccatatttttgaatatactttcagcggtgcattcatggttgatggatataatcaagcaattgcaatacatacaaagtcagcgtattgaaagaccaatgagacgcccggttactttgtttggatataactatataaggagagttttgcgtcaagacccagaagactttcgaagaagttataggatgtaccctgatatttttctaaaactatgttgtatcattagagaaagtacatcattatgtgatacaagatgtgtttctattgaagaaatgcttggtacatttttactcgttgttggccaaagttcacgatattgcacaatacgtgacacatttggtcgctctcggtggacagttagtaaaaacttcaacaggatgttgcgagctttaaattctatagctccgaggatgatggctaagccaacaagtgcaactccatttaaaattcgtgagagtacacgattttatccttactttaaggattgcattggagctatggacggcacacatatcccagcaatggtagagaaaagaaatgcagccgtttatcggaatcgacatggaattacatctcaaaatgtgttagcggtttgcaacttcgacttggagttcatatacgtgctcagtggatgggaagggtctgctcatgattcgaaaatacttaacgacgcaatgacaaaaagaaatggaatgaaaataccgcaaggtaaatattacttgggggatggtgggtttgcaaaccgacgatattgtttaacaccatttcgtggccaacgttatcatttgaaagaattttctggtacgggtaatcatgcgaaaaaggctgaagaattatttaacatgcgtcatgcttctttgaggaatgtagttgaaagattgttcggtgttgtgaagtctcgtttcttgatctttaagtctcaacctccatttccgtatcaggtgcaagcggagataatgacagcttgtgcaggcctacacaacttcttacgaaaagaatgccgttcagatgagtttccggtcgaggaagaggaaaatagccatccatcaacgcttgtaaatgacgacgaaattttgacacaacaaactcaagaacaacaacgtcaagaagctaatgcatggagaaagagtatagcggatgatatgtgggaaaatgttcgtgaacaaagggagttagaattgtatggagaccgttaa

SEQ ID NO: 172 - DNA, 382 bp, Papaver somniferum
catgtcttatataagtacgggttcggttatgatttaaaaacagaagattataaagttgcccgaatagcaaacatcagggataagtatagcgaaatcgctgtttattcattaaaattaaatttgtggaagatgtatggggacatccctgttcgatctccatacgaagatttagtgctttttgaaggaatttttcactgggtggaattgcccccctcggggtctcaacgtcctagaatgattttctcttttgatactggtagccagatactcaatagaattccactgccacagcatttctcagacaagtttaacatgatacatgtgcgtcttttgggaggttgtctttacctaattggtagtctgtatatgacatgtagcgagg

SEQ ID NO: 173 - DNA, 1743 bp, Papaver somniferum
atggagaagcaaaagagttttcgccgaggaatggagaaacagaagagtttccgtggggcgatggagaagcaatcgagttttcgtggggtaatggagaaacaatcgagtttccgcggtgtaatggagagacaaaagagcattagagaagcgttggagaagcagttgagttttagagacaagaaaaaggtcaaggagtcgccggggaagagaggtgatacaccacttcatttggcttgtaggggagggaatttgattaaggttaaagagattttgcaagattgtgatagtttaaaagatgtgttgacgaagcagaacaaggatggagagactgcgttatatgcagcgtcggagtatggtaatgctgtaattgttagtgagcttttgaagcatatggattccgaatctgcttcaatcccggcaaagaatggttatgattcatttcatgttgcagcaaagcaaggccatctagaggttttgaaggagcttctgcgctctttgcctgatctggcgcttacgacagattcatcgaactctactgcactgcatacagctgcaatgcaaggtcatattgatgttgtcaatcttcttttggagaccaatgttgacctagctaaaattgcacgaagcaatggtaagactgtacttcactctgcggcaaggatgggacatttggaagtggtaaaatccatattacgtaaggatccaggtgttggttttagaaaagataacaagggacaagcagcattgcatatggcagtgaaagggcataatgtagaaattgtgcttgaaatggttaaacctgataagtcagttatcaacttggaagataagaatggaaatacggcattgcatattgcaacgaagaaaggccgaacgcaggtaatgcgtggtttgttatcagttgaaggcatcagcatcaacgctataaacaaagcaggtgaaaccgcacttgacattgccgccaagtcagaaaatcctgaaatcgcctccattttaaaagaagttggtgccaccagtgctaaagactctgcaaaccctcctaatccagcaaagcaactaaagcaaactgttagcgacataaaacatgatgttgagtcccaacttcatcagactcgtcaaacaggagtaagggtacagaaaattgcaaagaggcttaagaaactgcatatcagtggtctcaataatgccataaactcagcaactgtcgtcgctgttcttatagcaacaattgcatttgctgccattttcacagtacctggccagtatgttgaggttaaatcagatggtttcacacttggacaagcctatattgcgaagaatgcagcattcatcatttttttcgtgtttgattctctggctctgttcatttccttggcggtggtcgtggttcaaacatcggtggttgtgattgagcagaaagcaaagaaacaactcatgtttgtcataaacaaactcatgtggctggcttgcctgtttatatcaatctccttcatttcactctcttacatagtagttggccgtcatgcgcggtggctagccatttatgtgacagtaatcggtgccttgataatgttgactacccttggtgcaatgtgttattgtgttgtgatgcatagaatggaggaatcaagtatgaggaatataagaagagcctctgggagtcattctcgttctttctctgtttcgggaatttcggatactgagatactgaacaacgaatataagaggatgtatgcagtgtaa

SEQ ID NO: 174 - DNA, 828 bp, Papaver somniferum
atggggggttggcaaaggcatatacaatctatcattcgccacgcgggtaaaaggttggagcaatgttgtagtccgccactcagtttaccaagtgctcgtataaatgcctcttttactttaggtcaattttgttatctacacagaacatcaaacacatctccgacaaacattctcaggcctcttcaccagtatctgaagcaatcgggaatttcttcttcaaggaagttgctttcagaagcatcctctgaccagacgcctgtagcaaatccactgtcgtcacctgttttgcaaataggtgacgggacaactgaaacccaagccgtggtccctaaacgtgccagcgttcaggcagtgttgaaggacataaaacagagtcccaaaaaggttaatctggtggctgcattggttcgtggaatgcgagtggaagatgctctattgcaactgcagcttacagtaaagcgagcatcaaagactgtttatcaggttatacactcagcacgtgccaatgcaacccataatcatgggttggataaagaccgtctcctagttgccgaggcatttgtaggaaaagggttattcaaaaagagagtttcatatcacgcaaagggaagatctggagtgaaagtacgagcagagtgtaggttaactgtcgttgttagggagatgacccctgaagaagaggctgagatagccagactaagagtacacaatttccgcaagctctcaaagagggagaggcgattggttccacataagctcatcgagactacccctgtgtggggccgcaaaagcaagcctagcaactcagagaagagttccatggcttga

SEQ ID NO: 175 - DNA, 864 bp, Papaver somniferum
atgggtaatctattgtgctgtgtacaagttgaccaatcgaaagttgctatcaaggaaagattcggcaagtttgaggaagttcttgacccaggatgtcattgcttaccgtggtttcttggtagtcaaattgctggtcatctcaccctaagggttcaacagctggatgtcaaatgcgagactaagacaaaggataatgtatttgtcaatgttgttgcatctatacaatatcgagctttagcagagaaggcaagtgatgcattctacaaactgagcaatacgaggggccaaatccaagcctatgtttttgatgtaatcagagctagtgttccaaagctcattttggatgatgttttcgagcaaaagaacgatattgctagagcagttgaagaagaacttgaaaaggctatgtctgcttatggatatgagattgttcaaacccttattgttgatatagaaccggatgtgaacgtgaaacgggcaatgaatgaaatcaatgctgctgcaaggctacggttggcagcaacagacaaggcagaggctgagaagatattacagattaagagagcagagggtgaggctgaatctaaatacctcgctggactgggtattgctaggcagcgtcaagccattgttgatggtctcagagacagtgtagtagggttctcaactaatgttcctgggacctctgcaaaggatgttatggacatggttctagtaacacaatactttgacacgatgaaggaaattggtgcaaactcaaaaacatctgcagtgtttatccctcatgggccaggtgctgttcgtgacgtggtaactcagattcgtgatggacttcttcagggatcttctgctcacatgacataa

SEQ ID NO: 176 - DNA, 1851 bp, Papaver somniferum
tctaaaacagagtcttactgtctaaagtggatttgtaataaaaagtctgaattcccctcaaacttcattctcttctttttatcatgttgttgtctgctggtttactatactctccttctccttctccttcttcctcttaatccccacagttcgccgccatctccaccaccaccaccaccaccaaattcttcacaaactggattctacaccatggaagatgctcaatcagttgccacgcttatagattccacaacaactaaaatacaacagcttcaacaagcatttgcagagcttgaaaaccaccgagctgtatccttaaaccttaaatggaaagagctcgaggcacatttccatgggcttgagaggtctttgaagagaaggtttgatgatttgggagaccaggaaaaggagtttaagaacaaggcatctgaggcgcgggaattactggagaagaagaaggctgcagtgaaggccaaggaacacgcttcattggagaagctccaacagaagagagatgctgccctctttgttatcggggatgcttttaagaaatacaagacgtcatctgtaaaacctgtggttgttaaagttgaggatagctgtgagtctgatttgactgtggaagagaaaccccctgacatgaaggttgcttccgttgatccagatgaagtgaataagatttccgacaatgaaactatggatgtaaaacctcgtcccgagttggccaagttatgtgaagagatggactctaaagggcttcataaatatatttcagataaccgcaagaatctagctaccattcgtgaggaaattccatttgcattaatgatctcggctgaccctgctcgtttggtgttggattctctggaagatttctaccgcatagaagctccaacctcagatgggaagagagactctggactcttgggtctccgacgaacttgtattatgttgatggaatgtctagcccaatctttagctgatactggacgggtttgtttctctgatgttatcaatcatgatattaaggaacacgcaaaggctattgctgaggaatggaaaccaaagttggatgacctcgatgttgatgcaagcagtggaaactcattggaggctcatgctttcttacaacttctggccacttttgatattgctggggacttcgatgaggaagaaatactaaaattaatacctacagtttctcgtcgccgtcagacagctgatctttgccgtctactaggtttgtcacacaaaatgccaggtgtgattgaagtcctggtaaatactggaagacaaatcgacgctgttaacctggcttatgcatttgaacttaccgagcaattttcacctgtagtattgcttaaatctcacttaaaagaagcacggaaagcttcctcgccaacaaagcctggaaacgcatctcccacagctgagaatgaggttaacgaccgggaactaacttcccttaaagctgtggttaagtgtattgaagaacataaactcgaggggcaatacccagttgaccctcttcagaagcggatctcccaactagagaaagcaaaagctgataagaagagagtggccgaagctgcaaagcctcagccaaagaggccccgtgctaatggtggtggttttgctccccgcgtctctaacatcaatgacaaaagcttctatgctacagttcccgataggtatcctccctacaactacgaaaacatgcactatgtatatccaggacacaccaacaatcatcccacaccggtcttgggtgctgcagcctacaacatcccacccaaccatggtagctatttcggaaatgggtatgcttaccaagccccatatctacactaa

SEQ ID NO: 177 - DNA, 1215 bp, Papaver somniferum
atggttaacataatcatcttattttctcttaaactcgttgtaattttccatatcatatttccattatcagcaactgcagttacttataatgttctaaactttggagcagaaccagataaaggaacggattcgactgaagctttcttgcaagcatggtctttagcttgcagttctatagcacctgcgatgatgtttataccccgtggaacttatttggtcaacacaatagtttttagtggtccttgtaaaagtgcaagagtcacagttcgaattgatggtaaaattcaggcgcctcctagcagttattgggaaattgggaattatgggacttggattttgtttcaaggcatcaatggcttaaccattaacggtgggattctagatgcacgcggatctccgttttggatttgtaggagagctagtgcttattgcccgcaaggcgctacgtcgctgtcgttcaacaatgttaaaaacggcatagtcagtggtatcgtatcttttgatagccaaaaggctcacatggctatcaatggttgcaaaagcatgaagattagaaaagtgactcttattgcacctgctcaaagccccaatactgatggtatagacatacaatcatcaactggtataaaaatccttgattcaagcatcagaacaggtgatgattgtattgcaataggtcctggcacaaaaagtttattggttcagcgtgtagtatgtggacctggacacggaattagcattggaagcttggctagaagtccaaatgaagcaggggtggaaggaattaaagtaaaggatgtaaccttcactggatcggataatggattacggattaaaacatggccgaaaccaagtgatagtttcgttaagaacgttctttatcaaaatatcattatgaataatgttcggaatcctatcattattgatcagatttactgccccggtaccaatggttgctctgaccagaattctggactcaagatcagtggtgtaacgtacttaaatgtaagtggaacatcagcaacaccaattgccattagcttccattgtagtgcaactaccccgtgcgatggaatcaaattatccaatgttaatctcacttattcaaagcaacctgccaagtccttttgtttcagcgccctcggaacatcatcagcgggacaactcggaacatcgttatcagtaggacgacccactcctggaagttgcttctag

SEQ ID NO: 178 - DNA, 627 bp, Papaver somniferum
atgatggaggaggtgataatgatgtcaatgatatctccttcagcatcaaattcgacttcaccacctggtggtggtggtggtggtggagcaaaggaacaacaagcagctggagtaggaatactattgcagataatgatgcttgttttatcattcgtattaggtcatcttcttcgtcgtcataaattttattttgttcccgaagctagtgcttcccttttgatcggtttgattgttggtggacttgctaacgtttcaaatacagaagcaagcatcaggccttggttcaattttcacgaggaattcttctttttgttcttgttgccgccaattatatttcagtcaggattcagtttagcaccaaaaccattcttttctaactttggagccattgttacatttgcaattctgggaacatttatttcttctatcgttactggagttctagtatatcttggtggtgtgttgctgctcatgtataaacttccttttgttgaatgcttaatgtttggtgcacttatctccgcaacagatcctgtcactgtgctatccatattccaggaacttgggactgacatgaacctatacgccctggtgtttggcgaatctgttctgaatgatgcagtatga

SEQ ID NO: 179 - DNA, 432 bp, Papaver somniferum
atgcgcaacacacctgcagatggtcccgtgagtacaaatgaaccattggaatgggatatgaaggaccttccgattgatgaactcatagatgaagatgtttcatcagattcaacaacaaaggaggaccaaatgcatacagaaccagggaagatttttgtgggtggaatgtcatgggataccgatgaagctactttgaaagatcattttaacaagtttggtgaagtggtggagactaatattctgatagacaggactacaggttgttcaagaggttttgggtttgttcgcttctcagataaatctgtagctgataaagttcttttagaaaaacatgtcattcttggaaaaaaggtagatgtgggaaaagtagtgctaaagcataataatccttacgatcgaaagggttttaataagagtaatggtaataatggc

SEQ ID NO: 180 - DNA, 413 bp, Papaver somniferum
actagaaaggtgcgttccctaagagatatttataatgtatctaattgtgcttttatagcactagaacctcaaaaatatgaggaagcggcaaaagaagaaaaatggagaaacgccatggacgaagaaatgcgagtaattgagaaaaataagacatgggagctcgtcaatcagccagttgataaagaaataattggtctgaaatgggtctacaagataaaatataatgaagatgggtcaattcaaaagcacaaagcaaggctagttgcaaaaggatattcccagcaaccaggaattgactacaacgagacattcgccccagtcgctcgcatggaaacaattcggatggtgttagctttggcagctcaactcaaaatgaaagtctaccaattagacgtaaagtcggcgttcctaaa

SEQ ID NO: 181 - DNA, 1101 bp, Papaver somniferum
atggttgacatgctaaaaaaaaaggctttccacaggtggattagtgagaaggatcttagagttgatgggaggcgtcttgacaatgttaggcggttaaaatgtgaatattctaaagtctcagaactggagggatcatcacaatttgcttgtgggctgactcaggttacatgcacagtgacacaaagaagaccaacaaaggatgaagctaaaaatatgggtggaaatcatccccttctccgtttccctagatttttgtacaatagtccacccttcagagttgatggaaactggaaattaggtgattgcaatagttatgatgcacgggacggcgattttgtggagaaagctttggttgtgctgctacctgtagaatataactttccatatgttgtttgtgtcgactcagaagctatacattctgatggttcagtctctacagccactatttgtggggggagtgttgctttaatggcttctggtgtccctctaaagaaacatgtggctggtgtttcagtgggcaccgtcagtgaagtttatcccactgatggaaagatgaacaattaccgaatactgacagatctatcaagtttagaggagcatctagtggacatgaacttcaaagttgcaggctcgcgagatggaattacagcaattcgattggatttaaatgtagctggtgttcctttaggtatcatctgtggctgcttaggacctgcattaaaaggttgccttgaagtccttgatacgatggaccaaaagatcagtaatcctatttattgtacttcagatgattggggttggagtgacgcgacagtagttgcatataggcttcccactaagtctattgaacgcttgactgtatctaatggtgcatggcagagggatttcgaacggaaaacaggaacaaggatttcgttgacgaaaaatggagcggttacaatagctgcaaagaatgaaacaagtcatttgctagctaggcaaaaggttgaaaatattattgcgcatgaggttgaatttggaaggctacatgaagacgaggcaaccctaatgaagagctacgtggaaatatcagctgagcaggttgaaagagcatatatgtag

SEQ ID NO: 182 - DNA, 342 bp, Papaver somniferum
atgatcacaggatcaattgcaccatcaagcttacatggattaggatgctctcttcttggagtcacaaatccgataagctttgatccattggactcagtgataaccatgatgctaccttcaagagtttctgcaagaccaacccaagctctattcatgcatcgtcttatcttcaacccattatctctgacagaaagatatcactaccatcaccaccagcaatttcttcaaaacacgtatttagcaccaccaatagttcctgatttccttattgacaagaactcgaatatagttggttcattcatgttattccatattccatcaacatcacgtacaatctcttga

SEQ ID NO: 183 - DNA, 351 bp, Papaver somniferum
atggcatatgaaatgacagagaagtttgaagagtattggtttgtgatcaatggagtaatggccgtagaaattatgttagatccaaggtttaagatgaaattgattgagttttattttccacaactttatggtcaagcttttccaaaaatcaaaattgatcgagtacgcaatttatgcgttgatatggcgacggagtatgaactgaaagtaaaatttgctgaaacatctgttagccaaaatgatttgtctttcacttcggagatgcatggttttaacgatgatgtagatcctttggaaaagtttgatatgtttgtctttagtactgctcctactagtactgttaagtcataa

SEQ ID NO: 184 - DNA, 1161 bp, Papaver somniferum
atgtggaaaagatcagcttccttcattcttgatcaaagacacgaaaacaacaaaccccctttagatccttcatcatcatcaaatcaaatggctgctgagaaaaactcaaaaatctcagcatattatcaaacaagatcagcgcatcatgctgttgttacgagtgattggttagctcaatcacaagaagctgcgattgaatttgatccatctactaatgattatcttaaatcaagtactggtaattctggggagaaaccctttagtgtgattgatgaatttaatcattggagacaattacctgaattagctgaagctgttgctgcaatattagctttggcctctgttattcggtttagtaaagcttccactattatggaacttgagagggaactcaaaactgcttctgattctctaaagtcatgggatacgacttccatctctttgacagctggatgtgacttgttcatgcgatatgtaaccagaacttcagccttggagtatgaggacttcgatgctgcaaagttgcgcttaattgagcgtgctgagaaattcggtgaaatatctcgcaaggcacgaagaaccattgctatgctcagtcaagactttatcttcgacgggtgtacaatcttggtgcatggatattctagagttgtagttgaagttctgaagttagctgcacaaaataagaaactgtttcgagttttatgcacagagggaagacctgaccgaacagggttgcggttctcaaatgagctagcaaagctggatgttcctgtaaagcttcttatcgactctgcagtggcatacactatggatgaggttgacatggtatttgttggggctgatggagtggtagaaagtggaggtataatcaacatgatgggaacataccaaattgcattggtggctcacagcatgaacaagccagtttatgttgctgctgaaagttacaagtttgcacgtctctatcctttggaccagaaagatctcacccctgctttgcgtccaattgattttggggttcctatcccgtctggggtggaagtcgaaacttctgccagggattatacaccacctcagtacttgacgcttctgttcacagatcttggtgttctaacaccatctgtagtcagtgacgagctcattcagctgtacttgtag

SEQ ID NO: 185 - DNA, 510 bp, Papaver somniferum; identical to SEQ ID NO: 78

SEQ ID NO: 186 - DNA, 1543 bp, Papaver somniferum
atggatgcgattgagtttccttaccaaagggatgtctcggtttcgaagaatttgatgggtaaaggatttggtagagagcgtatgttagaaggggatcgatcagaatccatcagtgttggttcagttcctcgtagctccggtcttattggatgcagcactagtggtagtattaaagataaagctcgggcagtgaaacaaaaacatggcttagacggtaaacggagtgacaggaacaaagttaaaccacctatgaagactaaactggattcattcttttcgaagaatgggataacaagcaataactcatcctcaggaggaaacaacattcttgggatatatggtctgaaatcagatattcatgctgttacaagtcatgtggatgagctgtctctgaatgaaatccttgatggcagttataaatgtccgatcttatcccaaagcaaaggtaggaaatcagctaatacaactgataacattctacactcggttcggaaggtgtgctctatccttcaaccccagagagcacctgaaccatcacagaaagatgttgacctagacagtggttcaataaagatggaggcttgcatatctgataccggtttctgttcgtctaaaagagaagaaaatgataaagaagatggggacttgcacggagaaacttcatcttgtaagattgaggactcccataaaaagtttttggatgccaagctgctgcatcaacctaatgttattctggagcgcttagcatttcaaccagtaaaggatttggattcactcttacatgatacagccaagcctggggtgtctgttagtcctgatatacgagcagtcaagggaacatctcagagatatagattgccgcctttctattggtcacattcttttactggctcatgtaaaactaatgttgaagggagcaagttgacaattaggagtagcgcgttccaaagtagatgggtgagaatagagagcaccgcctccactcaaggggatagtactggttgtttttcagacctggactcgtttgcttgtgattataacctaaatactttaaaacatctaaacgtaggtctttcagaaaaggagccaacttcggcatccatcagttttcacaagcaggttctgttgtccacttccaaagatcctctcactggcttcccacataaatccgataattatttaggtgctcagtcaaagtttggttttaacatgaacattgttaaagatggtagaaaaatagaaaacagttatggtcaagaaaaatatttaaggtttgaagaaaacaaagataatggtgttggtggagaaccaagtaagagaaggaaaggtgcttgttctactgaagatggtagctgttattctatgtttaaatcttctgttactggatatcccaactttcctttgcatatacatgatccagatgacactaaacacgatgcacattctccaaggctactagctgctgctcagatacttaacgagatctcaagactttccagaactcagaatcagaacaggggaaaaaacagatggccgaaaaaac

SEQ ID NO: 187 - DNA, 537 bp, Papaver somniferum
atgcctttcgggctatgtaatgcccctgcgacttttcagcattgcatgatgagcatattttctgacatggtagaacggttcttagaggtctttatggatgatttttcagtgtttggttcgtctttcgatgagtgcttgcatcatttgtcattagttttgactaggtgtaaggaaaagaatttagtgcttaattgggagaaatgtcacttcatggttcgttcaggaattgttctagggcatattgtatcttcaaagggtatagaggtggatagagcaaaagttgaccttattaaaactttaccggtcccaaaaaccgtaagagatattaggtcattcttaggacatgcaggtttttatcgtcgattcattaaggattttagcttgatttctagacctctttgcaacttgcttgcaaaagatgttaagtttgtctttgatgaagcttgtttagaggcttttgagaagcttaagactttactcactaccgcccccatagtccaggcacccaactggaacttaccctttgagatcatgtga

SEQ ID NO: 188 - DNA, 1050 bp, Papaver somniferum
atgtacattgcagttcctgtagtcctctatgcatgtgaaagaattgttagatttttccggtctgggttttactcagtccgcctcagaaaggttgctatttatccaggtaatgttcttactctacagatgtcaaagcctccaaacttcaagtacaagagtgggcagtatatgttcgtccagtgtccggcagtttcaccttttgaatggcacccattttcaataacttcagctcctggggatgattacttaagcatccacattcgacaacttggtgattggacgcaggaactcaaaagagttttctcagaggcatgcgagcttccactagctgggagaagcggacttctacgagctgatgaaacaactaagaagagcttgccgaagctattaatagacggtccatatggagcccctgctcaggattacaagaattatgatgttttgttacttgtcgggcttggaattggagcaacacctttcattagtattttaaaagatttgctcaacaacatcatcagaatggaggaactggctgattcaatatcggataccagtcgaacaacagatcagagtgttggaacttcctcagattcctctgtcagtaagttctcccctaaaagaaagaaacctctgaagacaacaaatgcgtatttctattgggtaactcgagaacaaggctctttcgactggttcaaagggatcatgaatgaaattgctgatcttgatcataggggtgtcatagaaatgcacaactacttaactagtgtgtatgaagaaggggatgcacgttcagctctaatcacaatggttcaagccctaaatcatgcaaaaaatggagttgacattgtttctggaaccacggtgagaacccattttgcaaggcctaactggaagaaggtgttttcgaaaacgtgctcaaagcacccaaatgcaaagattggtgttttctattgtggtgcacccgtcttagcacaagaattgggcaagctctgccatgaatttaaccagaaaggttcaaccaagttcgagtttcacaaggagcatttctaa

SEQ ID NO: 189 - DNA, 1898 bp, Papaver somniferum
atgaggggttttccgaaacatgaacgacggtgggcgtctgatacggtgtcttcaggtaaatttgcaagtggaagttcatcacctgtaaacaacgaaacatctggcgcaatggatcaagaatttgttcaagtaacccttgattttcaagacgatgatacaattgtgttgagaagtgttgaacctgctaccattattgatttagatcaagaaattgttatttctggtagtggtggcggtggtggtggaagtgaaacttctttatcatcagcggcatcaagatcaccaacaataaaaagaagttcatcgcataaatttcgtcagttttctcaagaactgaaaaaggaaacagtagccaaagctaaagcattttcacaagagtttaaagctgaacttaatagaagattttcatggagtcataatcaatcatcaaaaacactttcttcttctacagcagtagcaaatgataacaatgcgggaacttctgattcagctttagctgctagagctctccgtaaacaacgtgctcaactcgatcgaactcggtctggtgcacataaagctctgagaggattaagattcattagcaatagtaatagtaatagcagtagccataggaacaatattaattcagttgatgcttggaatgaagttcaaagcaattttgatggacttgcaaaagatggatttctttttcgagctgatttcggacaatgcataggaatgaaagattccaaggaattcgcattggaactatttgatgcattgagtagaagaagaagattgaagattgataaaattagtaaagaggaactatatgaattttggtcccagattactgatcaaagttttgattcaagacttcaaatcttctttgacatggtagataagaacgaagatggtaggattactgaatctgaagttaaagagattatcatgctgagtgcctcggcgaataagttggcaaggcttaaagaacaagcagaggaatacgctgctctcataatggaagagttggaccccgagaggcttggctacattgagttatggcaattggagacattgttactgcaaaaggatacgtatctaaattacagtcaagcattaagttacacaagccaagcattaagccaaaatctgcaaggactaagaagcagaagctcaataagaaaagtgagcagaaatataatttactacattgaagataattggaaaaggttatgggtaatggcattgtggattgggataatgttagggttatttttctggaaattctttcaatacaagaatagatacccatttaaggttatgggttattgtcttgttactgctaaaggtgctgctgaaactctcaagttcaatatggctctcattctcttacctgtttctagaaacaccatcacttggttgaggtctactagacttgcttctgttattccttttgatgataatatcaattttcacaagacaatagctggagctatcgtagtcggtgtaatcctccacgctgggaatcatcttgcctgtgatttcccacgcttgattaaatcctcaaatgatgtttttgagcctctaaaacatgattttcccggcgatcacaaacccacatatgccgcacttttacgtgggccagaaggtgtcacaggaattctcatggttattttcatggtagtggcgttcacacttgcaactagatggttcagacgtagtctcgtcaagttgcctaaacccttcgacaagcttacaggcttcaatgctttttggtattctcatcatctctttgtacttgtctacattttgctcataatccatgggttctacctctatctcgtgcaccaatggtaccagaaaacgacatggatgtacattgcagttcctgtagtcctctatgcatgtgaaag

SEQ ID NO: 190 - DNA, 1974 bp, Papaver somniferum
atgcttgttgatgcaaccagtggttacggtatgttctcattcatggatgattacagtggctacaaccagatcaagatgtacgaacacgatgccaacaaaactgtatttcgcactcccattgggaattttcactacaccgtgatgccctttggattaaagaatgcaggtgctacttatcagcgagctatgactgcaatatttcacgatatgatgcacaagcaggtggaggactatgttgatgacgtggtggtgaagtcgaagactcgagcatcccacctagaagttctgagacaagtctttgaaagatgcagagaatataaattaaagatgaatcctatgaaatgtgcatttggtgtttcctacggaaaatttttaggattcctagtcactgtagaaggaattaaagttgatccagacaagacgaaagctattactaccatgcctcttccatgcactgtgaaagaattccaaagttttatgggcaaggtaaattatattttcgacgcttcattcatccctctgctgaagaaaggagcaagtttgacatggacaaccgtccaacaagaagcattccagaaaatacaacaaatactattttcacccgctgtcgtgaaatccccggtgcaaggacgaccactgatactttataaagcttccagcgatgtctctattggagcaattctttctcaagaagacgaagaaaggatcgaacgactgatctactacttcagccgtacaatgagagatgctcaactcagatacccaaaagctgagagagcatgtctagcattagtgcatgcgattcagaaattcagacactatctgctatccaatagagtcatgcttgtttccaaagctgaccctctaaagtttttactatcaaagccatccttgatagagagaccagcaaaatggctacttcagatgtcagagttcgacatagcttgtgtactgcctagagaattcaaaggccaagcagtttccgatctgcttgctgctttcccaggcgaagatacgacaaagttacatgaagatgtacctggtgagtttccagagatcttagttatcaaagaagagacatggctcttatactttgatgggtcccccactcctagaaacgacaccgaaggagcgggcgtggtgctagtgtctccatctggtaaagtattctcgcgtttattcaaactggattttcactgcaccaacaattcaacagaatatgaggctttcttattaggtttgtccctggccaagcaagcaggagcagcacaccttgagattaggggagattcaaagctactggtcaatcaaatgaacggagaatattctctcaaagaaatcacgctcgcaccattcagaacggaagctcagcggatcttaactcattttgctggtgccacaatcatccatactggacgaactaataacatgcatgctgactgtctagaaactcttgcttctaaactgcaattcgaaggagcgaagaaaacaatcacggtaaaatggcgtgcggtgttatctacttggcttgctcaagttgaagacattcaaacgaacgattggagagcacccattattcatgaattgagcaattctctttcagaagggaaagtcagcctcaaggaactaaagaattatttcttgcttcatggagcattatactatcggaatcctgacgggtctttattacgatgccttggaaacgacgaagcaggcgaaaaactcaaacgcatacatgaagaaacctgcggacatacattagtggtaacactttacagaaggcttcaaaggatgggatactactggccttccatggaggcccaatcaagaaatctgcaaagatcttgtcctaattgtcagacgcctcctcatcacttagaagctttgacagtccgtcacaccgaggactggagggagccttacatcaagtacctacgggacaatgaacttcctctggagaaagggagacaataa

SEQ ID NO: 191 - DNA, 669 bp, Papaver somniferum
atggcaataaacttgtctcttggaggtaaacttacccttattctttctgttctgatgtccttgcccatttacttattctctcttttctttgcaccaattaatgttattaaaaaactagaaataattatccgcaatttcttatgggatggaggggtcgaccgcaaaaagtatcatcatgtagcatgggatatcgttctcaagcccaaaaatttaggtggtttaggagttaaggatttgcatctaatgaacatcgctttgttgatgaaatggttgtggaagtttggcgaagatgataatcctttatggaagaatttagtctctcaaaagtatggtattgaggagcatgggtggtatgcgagaaatcctaagcaagcttatggttgtagtgtttggagaggaattcaaaatcacttggtcgacttcaaagcgaactgcaaattcattgtggggaatggagaaagaattcaattttggaaggatatatggttgggtaacactcctttagcagagcaatttccatattccttcggagcatcttcacacaaagaccttactatagcgcaaatgtacaacacaagtgaaaatagttggtcgttgggtattacaagaagaatttatgatcatgttattgtttgtttcgcgggtttgcttcatgctttggatgaatga

SEQ ID NO: 192 - DNA, 2430 bp, Papaver somniferum
atgaagaatttcatcaccataacatcatcgtcaccgcctctttctatacttctccaccaaacagatgtccgtgccatcgcaaaccggtacgcagcacaattacagttctgttgtgcccagaatcccatatctcattctcttgcccaatcagttcatgcgaacataatcacctccggtttcaagccacgaggccacatcctcaatcgtctgatcgatatttattgcaaatcaaataacattgtgtatgcgcgttatttgttcgataaaattcctaaaccagatattgtctcaagaacaactctaatatcggcttactctgagttaggaaatgtaaactttgctaagtatatatttgatgaagcccctttaagtattcgtgatacggtttcttataatgcaatgattactgggttttcacataataatgacggttataatgcaatcaaactttttaatgagatgagaaaatatgggtttaaaccggataatctaacgtttgctagtcttctaagtgccgcagcgcttgtagctcatgatgaaagagagtgtaaacagctacattgtaatgtagtcaaagcgggagcagatttattcgtttcagttttaaatgcattaatttctctttatgtgaaatgtggattttcgttgtcatctccaatgagtgatgctaggaaattgtttgatcaaatggagaagagagatgaactgtcgtggatgaatatgatcactggttatgttaggaatggagagattgaatctgcaagggagctttttgatgggatgaatgaaaatttacaggttgcatataatgcgatgatttcaggttatgttcaacatggtttcatgttaaaggctttagagatgtttaaaagcatgcatttggagggtatcgagctcgatgagtttacttatacaagtgtaataagtggttgtgcaaattctggactctttcttattggtaagcaagtccatggttctattctgcggacaggatggaggccagcatctaaacttgcactacctgtgaacaatgctttggttacattatactgtaaatgtgggaaagtcgaccaggctcgtcaaatttttgatagtatgttggagaaggaccatgtctcgtggaatgcaattttatcgggttatgttagcgttggacgaattgatggtgctaaaaatgtgttcaatgctatgccagaaaaggatctcctaacatggatggtgatgatttcgggatttgcacagaatgggtatggagaagatgcgctgaagctgttcgaccgaatgagaaccgaggaccttgctccatgtgattactcgttcgcaggtgcaataaccgcatgtgcatctcttggagcattggaacatgggcggcagctccatgctcagcttattcagttagggttcaattcaagcctctcagcaggaaatgcattgataacaatgtacgcaagatgtggggttgttgaagcagcccatgtagtatttcatacgatgccttacattgactctgtttcttggaattccatgataacagctcttggacaacatggtcacggacttcaggcactaaaagtcttcgatctgatgttgcaagagaatattaaaccagaccgtattactttcttaatcgttctcactgcttgtagccactcgggtctggtcaaagaaggatgcaagtattttgaatcaatggataatgtctacggaataacccctgatgaagaccattatgcccgtttcattgatttactttgtcgagctgggaaaatctcagaagctaatgatttgattcaaaacttgcctttcaaaccaggggcacctatatgggaggcacttcttaatggttgtcggattcatggtaacatggaagtgggtattcaagctgcagatcagctctttcagttgacacctcagcatgatggaacatacattctgctggctaatatgtatgctgacgccggacggagggaagatatggcaaaagtaaggatgatgatgagggaacgaggggtcaagaaggaacctggctgtagttggttggaggtggcaaacaaagttcatgtcttcttggtagatgacacaagccacccacaggtgcacgaagtctatacttatcttagagaactgggcgttaagatgaggaaattgggttatgtccctgataccaagtatgtgttacacgatatggaatctgagcagaaggaatatgctttgtctactcatagtgagagacttgcagtagggtttgggcttctaaagttgcctcgtggagctactgtcagagttctgaagaacttgaggatgtgtggggattgtcacactgccttcaagttcatatcaaagttggttgagagagaaattgttgtaagagatggtaggcggtttcaccacttcaggaacggtgaatgttcttgtggtaactactggtga

SEQ ID NO: 193 - DNA, 1932 bp, Papaver somniferum
atgatgtggaattcactggcaaatatcaaagaaaatttaaatcaaatcgttcttgaagttcaagatgctacagatggtgaagagtttgaaatctatcgatctaattctaattctgctgctgaagattctcctattttcaatcggagaatttctcatcggtttgcccaatctaataattctcctctgcggtcacctatatcaagtggtggtgattcagctctcaaatctgagattgaaaaatacaaaacagagattcaaaaattccaggcatctgaggctgaaatcaaagcattgtcggttaactatgtagcattgttgaaagagaaagaggaaaaactctccagattgcatggagaaaatgagatgctgagaaagaacttggaggcagcaaatgcttcgcagcatgcatctaaaaatgaaactttcaataaaagaaatgtacataagggggttggtgaacaatctcccaacaggcaacacaaactgacagctcatgtaaacaaccattctattggaaaccacacacacaaaagtgtaattaaacatgacacttttagcaatgggaatgcagatactttacggtctgttgaaaaccttccgcggaatgaaaatgagctcgcagatttgctagaagagaagaacagatccctggtggcaatccaagctaattatgattcagagataaagaagttaaagatggagcttggtagagagcgtgaaagttcagcaaacatacattcaaaatttactgaggaacaaaaattgaatgaatcttttcagaaggagctccttgctttgaagacgcagaaaaacagagatatgactgagatgaaacaactacaaaatcaattgaatgataagttatcagaaatcagacgacttcaatcagagctgacgagaagggacaatgaagaagaaacaaatgagattattgagcgattaaaaggagttattgccaccttagagcaggaaaacaccaatcttaagatagagaaggctgaacttcaggctgtcgtagaaagaagtccaaagtctttacgtgctgatggtgatgcggataacccagactcttcagatagtcgtccaactaaattaaatgaggcacattcatctgtacagttcccgcaaaaggaagaaatggagctatccatgcaaaagttagagaaggatttgaaggaagcttgtcgtgcaagggataaagttttgcaagagttgactaggctcaagcagcacttgttagataaggaacttgaagaatcagataaaatggacgaggatagcaaaatcattgaggaacttcgagcaagttgtgactaccaaagttcaaaaatattaagcctggaaaaagctctacagcaagcgataacagaccaggaagaggttaagaagaataataacgatgagcttcagaagtcaaaggaaatggtcaacgatcttaaggaaaagctatctagctgcatgcgcacaattgatgctaaaaacgttgaacttatgaatcttcagggtgctcttggccaatattatgctgaaagtgaagccagggatcgcctagaaggagatttggctcttgtgagagaagaattagctagattgtctgagcttttgaaggatgcaaatcaacggatagacattgcaaagcatgaaaaggatgaaacacttgaaaagctttcacaaactgaaatgttgctcttggaaggaaaaagtagagttcacaaactggaggaggacaatatgaaactacgccgcgctcttgagcaaagtatgacaaggcttaatagaatgtctgttgattcagacttctttgttgacaggcgaattgtgattaagttactggtgacctattttcataggaaccatagtaaagagattgacaggttttggaccttatggttcgcatgctgggcttctctgaagatgataagcaaagaatag

SEQ ID NO: 194 - DNA, 507 bp, Papaver somniferum
atgaagatgatcaaaccactctatgttagcgtttctaagagatacggagacaaatctaggttttataacgggtccgtaacaacatcacctctacagagatcttctcctaagaagtacaaaaaagaatgtgaagataaatttgagacttccagtaagtcccctaaacaggggaatttgccatcaggattaagagttgtttgtaagcatctcggaaaaagccgatcttcgtcgaattttgctgctgtttctccggtgacatttccatcacagaggcaagacgattccatgtttcaacaggaagacggaattcagaatgcaatccttcattgcaagaaatccttcaattcaagattcgaatcttcaactttgttttctaattcagattcatcactgctctcaagatctattagcgacccttctcatgagaagtcaatcgattttttatctgagaaaatgaaactcttcgaccaagatgaagccgagaatgaagaatattttgatctatga

SEQ ID NO: 195 - DNA, 405 bp, Papaver somniferum
atgtttcttgttggggttgtgtttaatttgttcaaatatcaaactcttgacaagggcacgtgtaatgggagcgtctctaatatcatccctataatcggtacaacaagtatgttcatcattgtagcttcaaagtacaaaatggttcttcccaccagaagtctttggcgatgcatgaaatctccagttacaactatgttcttcataaaaacactccaccgtatatctactctcatcacttttcacaacgctaatctttcgaccaaaaaagtgattatacttttgtactgcaaggctaacttcatcacatccacccatgattcttggccgaccccagttacaacaaattcacattcagcagacttgttacctttcttagtctctaccattctattgtacgcacgatga

SEQ ID NO: 196 - DNA, 1028 bp, Papaver somniferum
atggagaacatgcaatatgcagaggaactcataaggcagtttttggttttcagagggtttacaaatactcttcaaactttcgaaacagagttatccactgatattgctaaagggtttcaggttgataagatattggaattaatattttctgtgtatgtacccaaattccagattgaaaaattagtttgtctattaagttttttcaagcagtgcttttctacttccaccgagacggtacttgtatccacgctttcaaagttggaggcttcagttctacgatattacgttgttcatgctattaaatcagggaaaagggacaaagttatagacttttttggagcatatggtaacgatttgctgcaaagaagccaggattggggtccatggtttgctattccatatctgaagaatccaagtttggaacctcagtttcgcatttacttctcgaaagagtggtttgacgctttgcaactctcattgaggaattttctgagtgagatattcaatgatactcgtattcctggtctgttaaagatcagtgctgacaataatacagttaaacatctcaagagagacaataagcagttaaatctcaagttatcgcaactccaagctttattggaagaaaaggaagctcgaatataccagttaaagagtaattcatctacagcagaagtaaacatgcttcagaagaacaatcccacatacagtgaatcaggggctgcgggagaatgtgccacacaaagtaattatttatcgtcaagggtcatgagtgagtcaagtacatcacgttctacatcctctcgggatgataaaaaggaaccagagtttcaagatctggattctgctgaacgtgcaaagagatcagagaatttgacccaatcgggatcagaaattgattcaagctgtttgcatgagcttcctactcgagatgagaatggcgcggaaatgcagagacaggaagactttccagaagtaaaagcagaatttcaggaaacattcttagggcacaccagtccaatcagcag

SEQ ID NO: 197 - DNA, 900 bp, Papaver somniferum
atgcaacagttcgattcagaggattctgctatgacttttgatgaggcttccatggagagaagcaagaactttgttaaagcattgcaggaattaaagaacataaggcctcaactctactctgctgctgattattgtgagaagtcttatcaacatagtgatcagaaacagatggtattggacaacctcaaagactatgccgtacgagctcttgtgaatgctgttgatcacctcggtactgttgcttacaaattaactgacctctttgaacagcaaacattagatgtctcgaccatggagataaacatttcttgtcttaatcagaaacttaatacttgccaaacatactcgaaggaagaaggcttgagacagcatcagttgtatacaaccgttcctagacatcacaaacactatatcttaccaaatgctgtcaacaagaaggtgcaatttagtacacagatacagaccgatgctgtgcaaaaaaatattgcagcaagaccacgtgttcacctgtcaggtacaaatgcatcacaaactctttcttggcgtttagcatcggaaactgattctaccctaaatggctcaaaacatgcggtgatgcagtaccctaaaggctcaaatgtttctggaacagcatgcggagctttcaatttgtttgatgctgaagaagctgcatcatcaaaatcctcatctgcccagcttcatgcaggtggtcgaagtccagcttatagccccttgcggacatttggtgtcaaatggaaggattcttcagaggcatccaaaccattatcaccattcaggtctttcgataatgtcggtcgtcaagagcgtggtcgcagcccttctcgaagcaaaagcatgctttcatcattctttgctaaaagaaagacatcaaagatctag

SEQ ID NO: 198 - DNA, 804 bp, Papaver somniferum
atgcagagacaggaagactttccagaagtaaaagcagaatttcaggaaacattcttagggcacaccagtccaatcagcaggtgccgcttttctgcatctggaaacaatattgcaagtgcttcagtggatggaacagtcaggatatggacatatgactcgtcatccccaacaactcgaaatgcaactatatattgcggttctgagatcatgtcacttgactgggagtgcaaatctgatcgcctgcttctcataggtacagctgatggggggattaaagcctggaatgttgatgcaaagagagttgtctgcgatctcagcacgtcagcatcatttcctagtgtcttggatttgaaatgcagccctgtggaaccaatttttgtttctgcagccgcatctagagggcacggctcgagtaatcttgacaggatggggtttgcttcacttactgtttggaacatgaagacgtggaaggcaatgtcagtccttcctctcggcgaagatccaccagcaattacgtctctttgtttcaatcacaatgggaaaattttagctgcttctgcaactgatggaatgattcacatgtttggtatccttgactgtttatcttacttttgtgtatctgggaataaatttaatttaatcctgctatgcagtcgcatggtttgtttgtttttaaattggtcggatcagtataattggaaatttgctagttttgttgtttacggattaaggcacatgaacttatacttaacttgctgtagatatggctgcgggtcttcaaattacaggctggcctgcccatga

SEQ ID NO: 199 - DNA, 534 bp, Papaver somniferum
atgatgaatcaacaaagcatgagtttgtctttaaaccggaattcttcttcgcgcaaatttgctattcgttttgtaagggctttaaccagaataaaaatggccacaccgattgtatcatcagtccagagtcggaaaaaatgtagccggagaattaagtgtgcagctgatacatccatggcagcaactattgggtctagaagagcttggggtcgtgctatccttttgaaacatcgaaaccaagttagaaaacgtgttttgatgaggcaaaaagttgttggtaataataaggggaataaaactaggaagattaaggtgatgaataaagagaagaagcagattaataaagcaaggaagattgatcatattaagggggttcagggatctgtaaaccgagctaataaactccgaaaacttgttccaggaggagatgccatggatttttgtagcttattggaagaaactgctcactatattaagtctcttaatacgcaggtacagcttatgcagaaaatcgctgacatctacgaaacttga

SEQ ID NO: 200 - DNA, 1434 bp, Papaver somniferum
atgtcggcaaaattctcaccaactttacaaatcagtgatctcaatgattacatcgccccatcacaagcttgcatagtctctctaaaggggactactacggctaagaagcaggagacagcccagaaccaagtggtgattgcaccttctgtcaaacaattgaacacagaaccagttacaatttcattgaaagactgcttggcctgcagtggttgcattacttctgcagaaaccgttatgcttgagaagcaaagcttggaagagttccttactaatatcaaagatggaaaggatgttattgtgtctctctctccgcagtctagggcttcattggctacacactttggcctttctccatctcaggtgtttggaaaactcactacctttttgaagtccttgggggtaaaggctgtatttgataccagctgtagtcgagatttatcactcattgaatcgtgtaatgaatttgttgctcgatataaacaacaacagtcgttgccaatgatttcatcagcatgtccaggttgggtatgctatgcagagaaaactctgggatcttatattctacctcacatttcgtctgtgaagagtccccagcaaacaatgggagccacaatcaagaatcatatttgtcaaagaatgggtttccggccggagaatgtctaccatgtgacagttatgatgtgctatgataagaagctcgaagcttcgagggatgattttttgtttccgctggactcaaatggagaaactaggaatgatgccgaaaacccaatggttgcagaggtagattcggtcttgacatcaggagaggtcttggaattgttacagcgaaactctgtggattttaagaccttggcaggttcaccattggatagactgttaacaaatgttgacgaggatggacgtctgtatggtgtcagtggaggctctggaggctacgctgacacaatataccggcatgctgctgaagtactagctggaaaagaaattgaaggacctcttcattttgaaccaaaacggaagaattcagatttccgtgaattaaatctggatgtggaagtggagggggagaaaagagttttgaagtttgccctttgttatggtttccggaacctgcagaatgttgtcaggcaaattaaaactggaaaatgtgattatcattatttggagatcatggcctgtccgtcaggttgtttgaacggtggaggtcaaatcaaaccaaaagaagggcagtcggcaaaggaattaattcaaacattagaaagtgcttatatggaagatgtggtggtggctaacccttttgagaatctgttagtgaaggggttatatgatgaatggctggagcaacctggttcggagaaagctaagaagcacatgtacacccagtatcatccgatggttaaaaacattacctctcaactccataactggtga

SEQ ID NO: 201 - DNA, 1638 bp, Papaver somniferum; identical to SEQ ID NO: 82

SEQ ID NO: 202 - DNA, 381 bp, Papaver somniferum
atggacttgaacagatgctgccccaaaaacgattctcctctacctaacatcgacatgttagtagatgcaaccagcggacacggcatgttctcctccatggatggatgtagcggttacaaccagataaggatgtacgagcatgacgcaacgctctatgatggcaatcttccactggagccgatacctcaagggagcagcctcaagaagataacgatgcccacgcgttatgtcgagaaagatccgtgcgagtcactctatcagacgatggtgcatgtctatcgtgctatattggagaatctgcgcttttggttatcctctggagctgttgaacgctcatctgcaacagcatctgccctgctaccagtttcgctgaagcagtaa

SEQ ID NO: 203 - DNA, 327 bp, Papaver somniferum
atgcaagatgatgtggctaagttggttagagggtgtaagttgtgtagcacatctaaaccttccaacagaaaatgcgggttatatctaccattaccagtaccatcaaggccttgggagagtatttctatggactttcttggtggattaccgaatactaagtctggttatgattacttgttcgttgtggtcgaccgattcagcaagatgatcgcattaattccatgtacgaagacggtaacgggagccggtgcaacaaagctcttctttgagcatgtgcgaaagcattttggtttacgtacttcgattatttctgatagggatagttga

SEQ ID NO: 204 - DNA, 336 bp, Papaver somniferum
atgtatgcggatcgggttgtagctgagaccaacaaaaggtctgttaaagaacgccttaatggagattcagatgaggagtatggtagaggcagaacgtcctttagcaaaagacagcggcaaaatgacaacaagtggaaacacgatctttatgacgacgaagacaaaccccgagtttcaactcgccgagttgctgctaatgacctgcgattgaaactccaaaagaagggtttgaagaaaacatatcaaaagggaaagggctctcttgcaggaggtgtccaggatctatgggtaaagctgtcagttggattatccaaattacactccacttctttttaa

SEQ ID NO: 205 - DNA, 1416 bp, Papaver somniferum
atgctcaaatcatccttggcacctattctttcaatcattccaatgaaaccaccaaaatatccagttgcgtgtctctcactttttcgtccatcagctgttcgtgataatgtctcagcaaacgcggttgaaccaccacctcagtcatatccaacttcagcttatattcatcttcctttctgcagaaaacgttgtcattactgtgactttcctattgttgctctcggttcatcatctgcgaacctacccgatgacattgatgatccgcgcattctgaattatgttcaactcctttgtcgagagattgaagcaacaaaggttctcaaatcggataaccactcacctcttaaaacggtgttttttggaggtggcacaccttctcttgttcctccaagacttgtttcgaaaatattagaaacgttgaactcgaaatttggagtgaattctaatgctgaaatttctatagaaatggatcctggaacttttgatgcacaaaaattgagcgacttactgaaccttggtgttaatagagtatctttgggagttcaagcatttcaagaggagttgttgaaggcttgtggcagagctcatagtttgaaacaagtgtacgaagctatagagattattggttcctgtggtgcaagtaattggagtttggatcttatttcatcactccctcatcaaacctcagaaatgtggaaagagagtttggaacgcgccataaaggcagaaccaactcatgtctcggtttatgatctgcaagtggagaaaggcaccaaatttggattattgtataaacctggtgaatttcctttgccagatgatactctatcagcagagttttacaaaatggcttcaaagacactctgtaatactggttacaatcattatgagattagcagttactgcaaaaaggggtacgaatgccaacacaatcttacatactggaagaacggatactactatgcatttggtcttgggtctgcaagtcacctcgacggggtaagattttcacggccaaggaaaatgaaagagtacacaagttacgtccaaaatctggaagatggagcattaattcagcatgaaaatggccaaaaggatgcgaaggacttggaaatggatgttgtaatgctttctcttcggacttccaaaggcctggacttgacatcttttagagaatgttttggtagtggtcttgttttatctctttgcaagacttttagaccatatatagagagtggacatgtacttctgttagatgataaaagaagagtgttagtggcagaagaattctggtcagtgctgtctaacgagagtaagattgaagaggaagtggcgttcattcggcttagtgatccagatggtttcctactatcaaatgagttaatatctattgcatttggttgcatatccccataa

SEQ ID NO: 206 - DNA, 546 bp, Papaver somniferum
atggatcagcctgctgtggagaattacgcgaacccgaaaacatgtttctttcatgtgcttttcaaggctggagctttagcattctacatactttcagcgcttttctttaatagttttgtgatcattttcgtggttacggtactacttgctgctcttgatttttgggtagtcaagaatgttagtgggcgaatattggttggtttgagatggtggaatgaaatcaatgacctgggtgaaagtgtctggaaatttgagtgccttgaccaagagtcattgtctaggatgaacaagaaggattcatggctattctggtggacactctaccttactgcggttgcatggatctttcttgggatattttctgttataagattccaaccagattatgtccttgttgtcggagtttgtttgactctaagcattgctaatattgttggcttcaccaagtgccgcaaagatgccaagaaacagattcaagcattcgcctcccaaacaattgcaaaccgcttttcatcaacgatacagtcagcattcagcgttgtctga

SEQ ID NO: 207 - DNA, 1311 bp, Papaver somniferum
atgcttctacaactaggcagtatacccacactcgtaatcacatcggccgaggcagccgaacaagtcttaaaaacacatgatcttgatttttgtaatagacctccattggccggtccgaaacgtcttacatataattacttagatattattttttgtccttacagtgagtattggatagagatgaggaaaatatgtgctcttcaactttttagtgtgaaaagagtgcaatcttttgcagtaatcagagaggaagaagtttcagttataatggattccatctctaacgctaccgatcctattgatatttataagttgttgataagtttaatagacaagattctctcgagggttgtttttgggaagacatttcaaagtagagatcaatccagtgacggtacacttcaggatatccttctcgaaaccatggcgataatcagtgggttttcagcgtctgactattttcctactgttggttggatttttgacaggattactggattccataggagcattgagaaatgctttcatgaattcgatgatttctttcagcaaatcatggacatgcatctcaacccggagagacagaaatcctcgcatgaagatctcatagatgttttgctgaaaatcaaacaggacggatcaagtactgttcgtctcactaatgatcatatcaaagcaattctttgggacgtacttattggagggatagacacatctgctgtaaccatgagttgggcaatgacggaactgatgaagaatccagaagcaatgaaaaaagtacaggaagagatcagaagtcatgatttaggagtgaaaaggatggtacaagaatctgaccttgatcacttcttgtacctaaaaatggtggttaaagagactctacgactacacccaccagctgcattgttgattccaagagaaaatacaaagcatcatgtcatccaaggatacgatgtatacccgaatactaggatcctaataaatgcatgggctatcatgaggaatccaaagtattgggataagccggacgaattcatcccagagaggtttgaaaatcgctacgctgattacactggaggacaaaattttgatttcatacctttcggtggaggtcgaaggagttgccctggaatgaatatggcgctcatatcgattgagcttatcctggccaatctactctactgcttcaattgggaattgccaaacggcatgaaaaaggaagacataaacatggaggaatcgtcgggtcttagtgttcataagaaatatccacttgagcttatactcaccaagtacttggtaaaggtataa

SEQ ID NO: 208 - DNA, 411 bp, Papaver somniferum
atggcttttgctgctagaatcggtagcctcctaaaacagagcatatcccaaaacattattgcttcaaatgggcatggttctttaccgtccatgtacaattctctcaggtgtatgtctggaggatcaaacctgtttgtcggaagtctttcatattcgactgatgattattctctaaaggaagcattctccactttcggtgaagttcttgaagctaaagttatcactgacagagaaaatgggaaatcaaggggatttggatttgttaattatagttccgaggagagtgccagtgcagctataactgggatggatggcaaggaacttgctgggaggattattcatgtcagctatgctaaccaaagacctcctcgcggtggtggtggctacggaggcggcggtggcagctggtga

SEQ ID NO: 209 - DNA, 550 bp, Papaver somniferum
atgcagatctcgagatgtataggtgatttatatttgaaggataacaagtataacactgagcaaatccttggaaagttcagactgcttgaacctatgctgaaacccgtcttgagtgcggacccagctgttatgtcttttcctcttcaaccaaatgatttgttccttatatttgcttctgatggcctttgggaacacttgagcaacgagcaagctgtggaaatcgttcacaggaacccacgtgcaggaagtgctagaatacttctaaaagcagcgctccaggaagtggctagaaaaagagaaatgcgttatgaagatctccgcaggattgacaagaagtttccgacagggtttcagagagccagcaactgtatacaggtttcagcagggagtcagaaagccagagtgcaggacaaagaagatatctgcaggattgaagagaacggtatgcgcgactaccatgatgatatctgcaggacaaagaagatatctacaggagttgctgccattgaattgtcaagtggacgcaatgctaacatggaggaagtgagac

SEQ ID NO: 210 - DNA, 315 bp, Papaver somniferum
atggaagatgagtatgcaaagtttatcaggagaatgaatccaccaagagttgttattgacaatgatgcttgtgaagaagccactctaattcaggttgatagtatgaagaaacatgggatactactagaagtggttcaagttctaacagatcttaacttactcataactaaagcatacatatcctctgatggaggatggttcatggatgtctttaatgttaccgaccaagatgggaataaactcaaagatgaaggagtgatcaattacataaaaatggtaataccgcttctttactcttggtctaatttggtctag

SEQ ID NO: 211 - DNA, 639 bp, Papaver somniferum
atgggatccacgggtttgagtcatggggggatagggagttccaggacaactaccagcttcaagagctcctcgagttctgttgactggcttggaagagagatgcttgatatgaatataagggataagacattggaagaggatgatgataaagatagtgaaccagaagtaatcgatagtgttggtgccgaagcagggcatgtaatagcaactacagttggtggtcgaaatggccaatcgaggcagaatattagttacatagcagagcatgtggttggaacaggttcatttggagttgtcttccaggccaaatgtagagagactggagaaatagttgcaatcaagaaggttcttcaagacaagcgttataagaatcgggagctgcaaattatgcaaatgttggatcacccaaacatcgtagctctaaagcataatttcttttcgatcacaggcaaggaagagccatacctaaatatagtacttgagttcgtaccaaacactgtttatggtgttgcaaagcactacagtcgggtgaaccagcgcatgccactaatatacgtgaacctccatacttatcaggtctgtgaagttcttgatatcttctctatgtattttcttacgtggagtcgttcttgggtttga

SEQ ID NO: 212 - DNA, 792 bp, Papaver somniferum
atgcatatactttttaagagacggatcgatgctcaaaaagctcttggcaagagttggatgaagatcaatggaggtcttattgtgggtgtaaagccactggatccagttgacaaacataaacttaatgaagatgatctcaacaaacaggatgacctggatctccgtctgcttcatcgttctgctgcctatttcttcattttaggttcaactggtaatgtgtacactgtcagattatccagaatcccgacgtgcaattgccccgactcagcgttcccatgcaaacacattctttttgtgtatactcgtgttctcaatctcccttaccgtggtggtgattgtacggcaagcttacttacagccgtaatcaacacaaaggcatcggcacctgaaaccttggctagtgctcgtctacgtaatcgctttcaccatctttttctgatgtcgaaagtgggtccccaggttggcccctctccgccaatggtcaagttgggagatgatgctacttgttcttttgatggatgtattgttccattcatggttaatggaaatcaatcagatagtgaggcaactgaagatgaggacgctgatgaagataatcaggactggggtattgttcaatgtggtacatgtagaaccgtgggacataaagagtgtttggcgttttcgagtacatttagaggattgaaggtacttacatgcatgatctgtgagaaagagtgctggatgggtcgttcagtactggatagctatcccaacctgacagctaaccttagcgatgatgaaggtgactga

SEQ ID NO: 213 - DNA, 957 bp, Papaver somniferum
atggctcaattactgagtcctgtttgtacagatttactcaaattccaaaaccctaataatcaattcttcagttcaattaaaccatggcgaatgttaacaaagatcaatagcaaccatttgataacaacatttagtggttcaaaacggcgtgactctagaattagagctgttgctgaagaatccttttctagtgatgcaattgcagatgattattatgccgttttaggactgctaccagatgcaacaccagagcaaataaagaaagcttattatacttgcatgaaagcttgccatccagatttgagtggaaatgatccagagacgactaatttctgcatgtttatcaacgaagtctacacggtacttagtgatcctgtgcagcgaatggtttatgatgagatccatggatatgcattgtcagcagtaaatcctttcttggatgacactagtgttaaggatcatgcttttgtggatgagtttagttgcataggttgtaaaaattgcgccaatgtcgcccccgatgtatttaatatagaagaagaatttggaagagctagagtctgcaaccaatctggcaatattgatttggttaaccaagctattgaaagttgccctgttgactgtattcattggacttctgctgcacaagtatctttactcgaagatgaaatgcgcctggttgaaagagtaactgttgcactgatgcttgctggaatgggaacttcctccgatgttttcagaatggcaaacaaccgttgggaaaagcgccaatccaaagtcttggaaaaggctagaataaggatgatgcagcaaaaagatgcaaataaatctgaaacatactggaatgacctttggggaaagcctgcaacctatgaaacttcaggtattaagaataaaacacaccaaatcttatttttcgaggttttctcgcttcctagttttatctctttcacctga

SEQ ID NO: 214 - DNA, 441 bp, Papaver somniferum
atggttaataaagatatatccgaatggaatgagcacttaagaaaaaacacatctggagacctacatgcttgcagagttagagaaccaagtagatggaatcctctgcattgtgattttataaaaattaattttgatgcagctttccaaaaagaaaacaaaactatgggatctggtctaatacttatcgatgatgcaggaattttctatggagcatggtgcatcctaggagtagctgaaaatgaagaacatgctgaggctattgcatcttgggaggcaatcaaatgggctaaaagaaataactctcaaaagttgcatatggagggagactgtcttaatgttgttttggctataaatagtaatctaggatctgttagatggactaataaccccattatcatggattgtaaggaaatgttaggaagtttcagtagtttggtataa

SEQ ID NO: 215 - DNA, 921 bp, Papaver somniferum
atggaagaaaccatctctacaacagcagaaaagaggtgtgcggttgttacaggagctaataaaggaataggactagagatatgtcgtcagctcgctattaatggtatcaccgttatactaaccgcaagagatgagaccaggggaactcgatctgttgaagctcttaaagggtcaggacttgctggtgtgatttttcatcagcttgatgtaaacgatgcaactagtgttacttcattggctggtttcatcagaactcgatacgggaaacttgacatcttggtaaacaatgcaggggacaacggagtaagactacaaatttctgaggaggctatgaaagacatgaactttcgatatggtgatgagaatgatgagattgccaagttgttggaggaatccattgaggagacatacgagagggtaaaacaatccatagaaacaaattactatggaaccataagaataactgaagcactgcttccacttcttcaactctccaattcagcaagaattgtgaatgtttcctccgtatatggtcaactaaagtttatctcgagtgagacgattaaagaggagctaagaaatgttgattgcttaacggtagagaaactggacgagcttatgcagaagttcttaaaggattttaaggatgggatgttggagactaatggatggcctgtattagtttctgcgtataaagtctcgaaagctgctatcaatgcctacactcgaattcttgcgaggaagttcccaacttttcgtgttaatgctgttcatcctggtttggttaaaacagatattgcattccaacaaggtaacttaacaccggatgaaggagctaaagcaccggttatggtggcattgttgccttctgatggcccttctggtttctactttgaccagatggagatttcaaccttttga

SEQ ID NO: 216 - DNA, 327 bp, Papaver somniferum
atgaatttaatgaactgtaagagtccagacattgcctatattgtgagtaagttaagtggatataattgtagtccagagcaagagaattcagatgcactgagtagagtattatggtacctaaaatactgtattaccttttgttttatttatgaaaggtatcttgttgtccttgagggactttgtgatgcaaactggatagttgactcagaggagtctaagtctacgagtggatatgttttcactctagcaagagggtttgtttctggaagtttttcagacaaacatatattgctcaattcattatggaatctgagagtattgcgttag

SEQ ID NO: 217 - DNA, 798 bp, Papaver somniferum; identical to SEQ ID NO: 54

SEQ ID NO: 218 - DNA, 903 bp, Papaver somniferum
atgaaacatgccccagtaaagattccgcttttcgtcattgctatcgtgtttcttgtatttgcctttgttggtttattccacaatgatgaaaactcaaggttactctctcccacttcgtttttcaagcttagcaattcttgttcaagtcaggaaaccaaagtaagtcattcgggtacccctgcgaaaaagaaaacaagaagtaatcttaccagcaagggttcttctaaagttactgaagtagaggaaatctacaaaaccgataatgaagacgaagattttcttgaaaacaagtgtgacattactaaagggaaatgggtattcaacaatttgtctcagccattgtactcggaccaatcttgcccgtacatcgacaaacaagtttcttgtgtaaagaacggtcgaacggattctgattaccgtcactgggaatggcaaccagatgattgtgttttgccaaggtttgatcctaaggctgttcttaataagctgagaaacaaaagactcatgtttgtaggagattcactacagaaaaatcaatggcagtcttttgtttgtcaggttcaatcaattatacctgcagaacagaagtcaatgcaacgcgggcgtcctcattctattttcacggctaaggaatataattcgacgattgagttttattgggcgccatttctcatcgagtcaaatacagacctcgatatcattgcggatccaaggaagagaatactgaaagtagattcagtaactaagcatgcgcagtactggatgggggtagatattcttgttttcaatacttacatttggtggatgaatggtataaagattaaatcactatggggttcttcgcaaacggagacgacgggtttgaagagttggatgcagaagttgcttatagaattggtctga

SEQ ID NO: 219 - DNA, 816 bp, Papaver somniferum
atggctgtccttaacattataaaattgattttcgtaacgggagttatctccgggatcttcacggagttaactgcgggccagaattgcggttgtgccgctaatgagtgctgtagcgagtttggcttttgtggtccagcaggagatcctgcatactgtggctcgggatgtcgagagggtccttgcacgcctcctaccgacgttaacgtagccgatatcgtgacaccagagttttttaatggaatccttaatcaaggcgattgcccaggtaagaatttctattcgcgtggcgcttttcttgatgcgctcagttcatacgatcgctttggtcgagctgggactcaagatgactcgaaacgtgaaatcgctgcgtttttcgctcatgcatcacatgagactgaaaggttctgtttcacagaagagaaagatggagctaccaaaaattactgtaacgagaccgacatacaatacccatgtgctcccgggaagctatactatggtcgaggaccgttgcagttgacatggaattacaattatggaccagccggacaagaaaataactttgatggtctaaataacccagaaattgttgctaatgatccagctgtttcattcaggactgctctatggtattggatgagaagtgtccataggatcataattgcaggccaaggtttcggtgcgacgatccaagctatcaatggtgctctcgaatgcggcaatcctgcagaatcaggcaaagtagactccagggtgaactattataccaattactgcacccaacttggagtggctccaggagacaatcttagatgctaa

SEQ ID NO: 220 - DNA, 720 bp, Papaver somniferum
atggagagaatcgaaggtttgttaggcccggaagacaacaagtcaagaacattgagcccatatgttactggaacatctgtgcttggtattaagtacaaagatggagttctcatggctgccgatatgggaggttcttatggttcaactctgcgctacaagaacgtggaacgagttaaaccagttggaaaacatactcttgtcggtgccagtggagaaataagtgatttccaggagatcatgcgttatcttgatgaacttatcttgtacgacaacatgtgggacgatgacaattctttgggcccaaaagagattcacaactatttaactcgggtgatgtataataggcgtaacaagtttgatccactttggaattcacttgtcatcggtggagtaaaaaatggcaagaaatatcttggcacggtcagtatgctaggagtgcattttgaagacgatcacatagcaaccggctttgggaatcatctggctcggccgatcctccgtgctgaacatagtaatgacatgagctttgaagatgctgttaagttactggagaagtgtatgcttgtacttctttaccgtgatagatctgcaatcaacaagcttcagatctctaacattactgaagaaggggtcacaatttcacagccttactctctgaaaactttctggggtttgtccgccttcaaagatccaaccaagggtgcccaaggttcatggtag

SEQ ID NO: 221 - DNA, 549 bp, Papaver somniferum
atgtccactacaggtactgtatctgttcagttccacccaattgttaaaatttgtggttctgaaaatgataaattcagtgtgatacatccaaaattagagtttccaaggagcaaatttctcagattcaatctttgctcaaccgatagtactcgcaagggatgtattgggagagtaagtgctgtaccagaagatgaagattttttttgggagaaagcgttaacgactttacttgatatggttgagactccgacgcatatgaagaatttgtctatcaaggagttaaaacaattagctgatgagatccgttcagagttatcttttataacgtcgaagatgcctcgatactttaaagccattctagcaacagtggagctgaccgttgtgttacatcatgtttttgattctctaacggataagatattgtgggatgtggttcaacaggaaaccgaggttacgttcatctcgaaccgacatgcttctgtagaagtcaattccatgaaacatcctactttagataacttagctcgaatccatctcttacatctttag

SEQ ID NO: 222 - DNA, 255 bp, Papaver somniferum
atgagcactgggatgatatcctcgacatccataatcaatattgaggtggctttatcaataggtgatggactgaggcctggatcaatttatgatgctaatgacaccgctcaatttgctgagcttttgacacaagaagagttaccacttcgagcgtgggagaaggacgtacaggtgatgaacgaaggacctgggcatattccacttcataagatccctgaaaacatggaaaacaagtctacaaggcagaaaatatag

SEQ ID NO: 223 - DNA, 306 bp, Papaver somniferum
atgatttgtaaagccatctgggcccggagctttactggaaccaatacaagaaagcgcatagagaatttcatccctagtaatgggagccaccaaattagttgcatcagaatcactcaccaccttagcaaattgaataaattcagcatcagagttattaataccagaagaaccagcaccagtaacaaactagaaaagaaggaagtacactcaagagcaatttctttatcttcatccaacatcacccgattagaattctttaaggataaaatattgtttctacatctcctttccttaacagagctatga

SEQ ID NO: 224 - DNA, 561 bp, Papaver somniferum
atgggttactttgatattccagtggatcatgtatatgggcagcctgtagttctcgactacctagccagcaaaaatatttgttctgatgatttggtagtggtttcacctgatgttggaggagttgctagagcacgtgcatttgccaagaagttatcagatgcgccattagccattgttgataaaaggcgtcatgggcacaatgttgctgaggtgatgaatctgatcggagatgttaaagggaaagttgcagtgatggtggatgacatgatagatactgccggtactatctcaaaaggtgcagctttattgcatcaagagggggccagagaagtctatgcctgcagtacacatgctgttttcagtcctcctgcgatagagaggctatccagcggtctctttcaagaagtgatcatcacgaacaccataccagtgttggagaagaattactttccacaacttacagttctgtcggtagctaacctattgggcgagacaatttggcgagttcacgatgactgttctggtacctctgaaccctattccagcctgggcattgactga

SEQ ID NO: 225 - DNA, 2372 bp, Papaver somniferum; identical to SEQ ID NO: 158

SEQ ID NO: 226 - DNA, 528 bp, Papaver somniferum
atcccaaaatttagggtttctgcttcatcatcatcatcaacagcttctcctcctattgtcccaaaatcaaaccctaagaaacccaatactcttctgtccgattcaattacatcaatttttgcaattggtttatcattatcgagaatctttcaaggggttttaaacaaggcaccagaattgggtgggaatttggtgaatactgctggtccattgttttttgctgcgattagggaaagacccaaaggttatttgaatacaccactgactgtggttgcttctggtatgtcaaaatggcttgatatttacagtggggttttgatggttagggtgttgctcagttggtttcctaatattccatgggatcgtcaaccactgagtgcgattagggatttgtgtgatccctatttgaatttgtttcggaatataattccaccgatttttgatacattggatgttagtccgttgcttgcttttgctgttttgggtgttttggggtcaattcttaataacagcaggggaatgtattga

SEQ ID NO: 227 - DNA, 789 bp, Papaver somniferum
atggatgtagagttgccattggataaactgtctttaaaacccattgatgatgggaagtttgttgttgttttagtagcaaatggaagtttcaatcctccaacttttatgcatttgcgaatgtttgaactggcaagagatgcattaaattcagatggattttgtgttattggaggttacatgtcacctgtgaatgatgcgtacaagaagaaaggtctcatctctgctgaacatcgcttacagttgtgtgagcttgcttgtagaagctcgtcgtttgttatggtggatccgtgggaggcgaaacaaagtagttatcagcggactttgactgttttgggtagagtgcagagttgcttgtgtgacagtggattggtacggagagagtcgcttaaggttatgcttctatgtggttctgatttagtggaatccttttgtgtgccgggagtatggatccctgagcagattagggccttatgtagagattatggaattgtttgtattcgaagagaaggtacgaagattgagaagattgtttcaggggatgagattttgaatgcgtataagaacaacattagagttgtggatgaactgatcccgaaccagattagttcttcaagaatgagggaatgtatttcaagaggattatcagtaaagtatttgactgtggatgaagtgattgattatatcagacaacacaacttgtacctgaattcggaggcaaatgaaaagaagcacttgcaagaggggaaggatgaaaagatgatgcttaaaaagaaagaaatatcagattga

SEQ ID NO: 228 - DNA, 279 bp, Papaver somniferum
atggtgatgctaggtagtggaggcactggattgtccgcagatgctgttgaggaggatgcaaacgagaccaatgagttaggacagaaagagcgtcctgctagtatcaatgatcatctcacaccagctgagaggcgctatattgagcaaagggaaagaatcgatgtccgcaggctggcaaagacttcaaacaaatctcaccgtgatcgcattcaagatttcaatcagtatctggcaaacatgagtgagcactacgacattcctaaagttggtcccggctaa

SEQ ID NO: 229 - DNA, 1095 bp, Papaver somniferum
atgagtagtttgggccgacttgatctttcttacaacaatcttcagggtgaattggatgaacaactttctcactggccagctgatgtttttgctgggaatttcaagctttgtggaagacctctggttacccaatgtaacactgaagacactgaacatgtccgctctcgtctgagtacctcatcagtagtagccattactgctaccttgaccttagctggcgttgttattctacttctggtggggcttatactagtctccagacgcaaacaccagtacctaagaagagaagatgttgatggcaacaatgcatattcttctagttcttcggtgcaacgaagattactcttccataacgcttcaacggctcgtgaatttagatgggaagacatcatggaagctacccatgatcttagtgatgaatacataatcgggtctggtgggtctggaacaaattacaaggcagagctaccaagtggggaaatagtagcagtaaaaaagatcttgcgtaaggatgacctgtttatggatagaagttttgcaagggaaattcaaactctggggaggataaggcataggcatttggtgaaattgatgggatgctgtagtactagcaaaggaggaggaatgggttgtactctgttgatttatgaatatatggagaatggaagtttgtgggattggttacatcgacctatgacacaggagagtaccaccaagaaagttgggataaacctcgactgggagataaggttaaaaatagcagtgggattggcacaaggtgtggagtacctccaccatgattgcgtaccgaaaatcattcatagggatatcaagtccagtaatttgttactcgattctgatatggaagcacatttgggcgatttcggtctggccaaagtactgcttgacgatcaggattcttacctggtttgctggatcttatggctacatagctccagagtatgcttatacactgaaagcaacggagaagagcgatgtttacagtatgggaatagtactaatggaacttgtaaccgggagaatgccaactgctggaacttttggagtgaatatagacatggtgagatgggttga

SEQ ID NO: 230 - DNA, 1425 bp, Papaver somniferum
atgcagagagttagaattattttaagatttgtaattcttaacatttttgtaatcaccccatacaaccaaaaattggggttttgcttaaatgtatggtttaaattaaatgtatggtttatcacattgcagacttgccttttgacaatgcgaggaggatccagttcaacacctactgcctctgtttcttctaataagcggccacctcgacctccacctaatgcaagttcagatggaggtgcaaattcagctggaggtgcaagtgctgctaaagatgctagtgttgctggagatgctagtgcagatggagatgcaactgaagctgtcataaaagtgacagaaacacatagcaataagcgtaaaacccctgaagatgcaactgaagatgacacagaagtgagtcaagtgacagaaccaaagggaaagaaacgttctgatgtgtggaaccactttgatatggaccccaagccttcgaaatatgcaaaatgtcgccactgtaagacaaagattgcagctcagggtaccaagtatgggacaggtggtatgaataatcatttgaagatatgtaaaaagaagcccaaggaggaaaaaggacagcaaacgcttgattttcaaccggctaggctaggaggagaaggaaaattggttgcagcaacttttaatcaagatgcatgtacaaaggcagtgattttatttgtgattttagatgagcagccgtttagagtggttgaaggagaagggttcaaggaactttgtagggtacttgaatccagattcaagatcccttctcgtatgaccatttcgcggggtgtgttaaatttgtatgaagctgaaaaggagaagatgaagaactacttcaaggaaaacaatgtgagagtttgtctcaccactgacacatggacctcaaatgcccaaaataaaagctacatggttgtaactgcgcattttattgataaagattggaagctgcacaaactggtaatcaactttttccaaattttaggtcattcaggtgaggtaattgggaagatgttagaggaatgtttgttagattgggaacttcctggggtttttactattactcttgacaatgttagtgctaatgatttagctattgattatctaagggaggatggtcatttaaaggagcaagtgattagttcaaaaggtgtactgaatactaagtttatgcaagttagatgtgctgctcatgtgcttgcacttgttgtgaatgctggcttgggagagtatcacatggctattaagagagtaagggcagtggtgaagcatgtgatgagttctcctgctaggttgagtaagtttatggattgtgctaaacaagaaaagatagattgcaaaaaaaggtttagttttagatgtggatacaagatggaattccacttacatgatgttggaagctgcttgtag

SEQ ID NO: 231 - DNA, 678 bp, Papaver somniferum
atggctacgctcgcttacctgctggaccaacttgccaccgcgtctaggttgacaagtacaaacatcggagggaacttcactttgctccaggtgtggatatatgaccatttcccaattttgaacttggccaaagtatttgacaaagatgtcgattatgttgatactgagccaactgcagcacggtacgcgtacgaggactccaagaaaaggaacaaaaagaagttggtggaaagtttgagagagacgttagactgtcttggtgttgatgatgtcgcttttcaaccatatgagaatgaagatgaagaagatgaagttgttgaagatgaggatatgccagtaggtatgtatcatgggccattgtggtatcccggtggttatgttatatacgatcctaggcgagtactccgtcaattaggatgtgtccaaaaggttcctttgtttgacgagaaattcaggttgttaccaaagagtggtaagggaactaaaatcaccacttcatcttgggaaccaaagtatgatcctgatcccaccgttgagttttggaataatttagacaatcacacattagatgtgtccaagttaacacctttacttgatgatccatgtgaagaggatccgggctatatggattggtataaccaaatttctcatcccttcattatcaataagaaaagataa

SEQ ID NO: 232 - DNA, 401 bp, Papaver somniferum
atgaacacccatcagtcagttttgactccggttaagcggtcatggtgcaatggaatgacaattttgaatatcatggttgtagtaataatactagtggtacaaatctcttcaacctgttgtttagcttcttcacagcaccagaatctggtgagatggaatcatccaaagcgtgaattgctcgacagaatcaatcggaaaggaccttatatcggggtggtgatggcttactctactgaagaaatggctcttcaagcttctggtgtgttcatccccaactgtcacaacccttccgttgacttgtctggtaggcggcatcctttctatctccattattattggatcttacagttgccacgtcacctttttcttttctttcttttatctttgatttttcttttttc

SEQ ID NO: 233 - DNA, 2568 bp, Papaver somniferum
atgggtggtactagtattaatttggtggtggtggtggtggaattagcggtggttgtttctttgttgagtatgagaatgggtttttgtcaagaagatgagaattcaactacatcaatttatattgtttcactgaaacaaacacctacagttcttctgaattttaataatcaagggttgaatttagagaagaggactaagggttttatgcatagaaacggttcttacagtagactcattaccaaacatcacagacctaggaattattcaagatctgatcggcgttatgctgctcatataagccgggttcatgattctttgttgaaaagggccttgaggggagagaactatttgaagttgtatagctatcattatttgattaatgggttcgctgtgcttgtaacacctgagcaggcagagaagctttcgagtagagaggaggtagctaatgtgatcctggattatagagttagaactgaaacaactcatactccacaattcttggggttgcctcaaggtgcgtgggttcaagaaggtggacctgaatctgcaggcgaaggaattgtaattggattggttgacactggaattgatccaacacatcctagcttctcagataacctttccggaaatcgtttttcagttcctacccacttcaccgggatgtgtgaagttacgatggatttcccatctggttcatgtaataggaagctgattggggcgcgtcattttgccgcatcagctataaccaggggaatattcaatgcttcccaggattatgcttccccttttgatgccgatggccatggaacgcacacggcttccattgcggcagggaaccatggtattcccgtcattgtggctgggcatcactttggcaatgcaagtggaatggcacctcgcgcacacatttccgtttataaggccttgtacaaaagttttggaggcttcgctgcagatgttgttgcggcaatagatcaggcggctcaagatggagtagacataataagcctgtcaatcactcctaacaggcgtcctcctgggattgcaactttctttaaccccatagacatggctttgctttcggccgtgaaagctggaatttttgttgtacaagcagcaggaaataccggaccctcacccaagagcatgtcttctttcagtccttggattttcacagttggtgccgctgctcatgacaggacctacagtaattctttagtacttgggaacaatgtaaccatcactggagttggacttgcacctggaaccgatgagagtacaatgtacacactggtttctgctcttcatgcattgaacaatgacacgaaagatgcaactaacatgtacgtcagtgaatgccaagatcccagcagtctaagcactgacgtggtccaaggaaacctcttgttgtgtagctactctatccgctttgtgcttggtctctctaccataaaacaagccttggagacagcaaagaatctcactgcagtaggtgttgtattttatatggatccttacgttataggatttcaacttaatccaactccaatggatatgcctggcgtgataattccatctgcaagtgattccaagattttactcaagtattacaactcttccttggagcaagatccgctcgcagataaattcaaatttggggccactgcaacaatattaggaggtttaaaggcaaactatagcaactccgcaccaaaggttatgtattattctgcaagaggacctgaccctgaagatagttttcttgatgatgctgacatattgaaacccaatttgatagctcctggaaatttcatctggggtgcttggagttctgtgggcactgactcgcttgaatttcaagatgagagctttgcaatgatgtcagggacaagcatggctgcaccacatgttgctggtcttgctgctctggttaaacagaagtttccaagttttagtccttcagctatcggatctgcgctctccacaacagcttcaatgcataacaagaagggtgaaccaataatggcccagcgtgcttatgcaaatccagatttaaatcaatctcctgcgaccccctttgacatgggaagtggctttgtcgatgtaacttctgcgttagaccctggactgatttttgattcaagttttgatgattacttctcatttttatgcggcattaatggatccggtcctgttgttctaaactacactaaccagaactgtggaaattcaacaatcaactgccgtgacctgaacttaccatcaatcacaatagcaaaactaaaccaaaccacgactgttgaaagagtggttaccaacactgctggaaatgaaacatacaatttatcttggtttgctccttacggggtttcagttttggtaacaccgaaacgcttcttcattgaaagcggacaaaagcaagttataaccgttaccttgaatgctaccatgaacagttcggcagcaagcttcggaagaatcagtctgtatggaagtcagcggcatataattagtgttccattatcagtgatctataaaatctcttacaacgtaactgagaacagctaa

SEQ ID NO: 234 - DNA, 747 bp, Papaver somniferum
atggtacaatattttttcacaaatcatcacatgctcaaagaaatctatcatacttatcaagtcctaatacaaaaaattactcatccccagaccccagtagaatacagaccaattagtttatgcaatgtcagctataaaataatttcaaaaatcctagcaaacagactcaagccttttttatccaacattatttcacctacacaaactgcttatgttcctggtagacatatccataagaatgttatcattgcgcaagagttgttacatactatgaaaaccaggagaagtaaagatgctcttgttggattaaaattggatatgtcgaaagcattcgacagacttgaatggtcttttttactttctatctttcgaaatattggtttttataatgattggattgcaatgatagatcagtgtatttacaccaaaaacacctccttactcattaatggttctccaactgccacttttacaccttctcgaggtattcgtcaaagggactctttgttgtcatatttgtttatgttcataatggaggctttctctagtcttttacaaagtcaaattgatataggtcatcttacaggtattaaagttgcaaaacacagcccaacaattaatcatctattttttacagacgattgtttactgatttttcaagctaataactctcatatgcatcatcttcataagttacttcaatcttttggtcaagcttcaggtcaggtaatcaatatgcaaaaatga

SEQ ID NO: 235 - DNA, 299 bp, Papaver somniferum
atgagtcccaaagaacatgaagaattacgtcgccaagttgaagagcttatagccaaaggttttataagaccaagtcttatcccttgtgcggtaccggccttgttagtaccaaagaaagatggttcatggcgtatgtgtgtggatagtagggaaatcaatagaatcacattgaagtaccgatttccaattcctcgtttggatgacttactggatcaattaagtggagcatgtgtttttagcaaacttgattttaaaatggatattatcaaattcgtatcaaggtgggagatgaatggaag

SEQ ID NO: 236 - DNA, 1044 bp, Papaver somniferum
atgtgggttttctctgaagctgatgataaagtagtaaaattgcaagataataataagatagaagaaaagataatcaaagaagaagaagatgaagttgagaaaagtggagaggtattgttttgtggtggtcatactgatggaaatttgagttctcctactcgattaagacctctaattggtgttaacattcgttatgttgctgctggttgcgtatccttccattgtgttgcattggatgtggaaggtcgtgtttatacatggggaaaaaataagaggggacaattgggacatggtgatatgattaatcgtgataggccgacaattgtatctggactattgggacacaaaataatcaaagcaggcgctggtagagctcatacagtggtggtgactgatgacggaaagtcctttgcgtttggctggaataagcatgggcaatgtggaacaggttcagcaaggactgagtttcagcggtcaccagtttctagtcaagtttctgaagtcacaaatgttgtttgtggaggtgattttactgtgtggctgtctcctgtggagggatcgtccatattaactgcaggtcttccacagtatggtcaactagggcatggggcagacaatgagtacaacattaaaagttgctctgtgaagcttgcttatgaagcccaacctcgtcctaaaacaatagccgcttttgcagggaaaactgttgtcaaagttgcatgtggaataaaccatacagttgctgtggagtctaagggttttgtttacacgtggggttatggtggctatggaaggctggggcatagagagcagaaagatgaatggactcctcgtgttgtagctgtcttccaaaggaagaatgttctacctcccaacgcaattgtggctgctggtgctcataattgtgcagtcactgccggtggagggcaattatacatgtggggaaaagtgaaggttaatagcgaagattggatgtatccgcagcctcttcttggtttaaggttttgtgatgggccttacatgttttcgtctgggagtgtttag

SEQ ID NO: 237 - DNA, 618 bp, Papaver somniferum
atggcagaagtagtttcagagattccacaagaaaccatggaagttgaaactcctcaaaacggttctgaaacgaacggtgattccaagcgatctagagaaaacaacggtgttgaagagaatgaagcagcaaagaaacagaaggtagaagaaggcggagatgatgaaactgaaggtgaagagaagaaatctgaacctgttcagcttggacccaaaactttcaacacttctgttgaaatgtttgattatttctacaagttccttcattattggcctcctaatttggatgttaacaagtatgagtgcatggttttgctcgacttgatcaagaagggtcattcagagtcagacaagaaggttggtgcaggggtaaaagcattccaagtccgttaccacccaatgtggaaaagtcgatgttactttctgatcagggaagatgaatccgttgacgatttcagcttcaggaagtgtgtcgaccacattcttcctttgcctgaaaacatgaaactaaagccagaagcaaataaggcattgggtggcagaggaggtggaggcagaggtggtggtggccgtggaagaggtggccgcggtcgtggaagaggcaactggaataggaactaa

SEQ ID NO: 238 - DNA, 780 bp, Papaver somniferum
atgattctttcttttttcttctttgtatccttcttcatccatattcttttctgttcgttaggatctgtatacttcttagagctccaatataatagttcaatggcgcataacacagaagagtcgttctctaacaatactaataaccatcaagcctacaacatgatgaatattacttcatcctcatcagttgataactcaccaacaccaacaacaaccaaagttccatcatcgaaattcgatttcgttaagaagttatacgaagagcattgcccaccaggctttctcaaaaaggtgatcgcagagataatagctacatttctgttagtttttgtgacttgtggatcggcagcgttgagcaacactgaagatcacaaagcctctaagttaggagcttcagttgctggtggacttatcgtcacggttatgatatatgccgttggtcacatttctggtgctcatatgaacccagctgttacgtgcgcttttgcggcagtaaggcatttcccatggaaacaggtgccattttatgctgcagctcaactgacaggggcactggttgcttcgtttaccctcggtgtcgtgttacacccaacccaaaatattggaactacttctcctactggaactgatctccaggctttagccatggaaattattgttacgttttccatgatgtttgttacctctgcagtcgccaccgatactaaagcagtacttattccgcctatattttctcgcaaaaagaacttcaaaaaaaaaaaatctttaaatcttttatga

SEQ ID NO: 239 - DNA, 1248 bp, Papaver somniferum
atgaagggttactatcaggcctctgcaagggagttaattagaattaatggaactactaaagctcctgttatgaactatgcagctgagacatcgttaggagttgtcacagtaagggctttttctttgaccggcaggttctttgatagttatcagaagctcatcgacacagatgctaagctcttctttcattctaatgctgctatggagtggttagttgtaagagttgaagcgctccagaatttgacattatttacggcagctcttctccttgttttgcttcctcagggtaccgtaaacccaggttttgtggggctctctttatcctatgctttggcgcttaccggcacccaagtttttctggctcgatggtactgcaacttttctaactacatcatttctgttgagcgaataaaacaatttatgcatataccatcagagcctccagctattgttgatgaccaaagaccgccaccttcgtggccctctaatggaaggatagacttggaaaatcttaagataaagtatcgtccaaattctcctctagttattaaaggagtcacttgcgctttcaaagaagggacaagagtgggagttgttggtagaactggaagtggaaagactacactcatcagtgccttgtttcgccttgtagaacctacaagtgggaagattcttatagatgggatagacatttgctcaatgggtctaaaggatttaagagtgaagcttagtataatacctcaagaagcaactctcttccgaggaactgttcgaactaatttggaccctctaggcctttacactgacgaagaaatatggaacgcgttagagaagtgccagctaaaagctacaatcagcggtctccctaaccatctcgatgcgtcagtgagcgacgatggtgataattggagtgctggtcaacgccagcttttttgtcttggaagagtacttctcaaaaggaacaaaattctagttctagatgaagcaactgcatcaatcgattctgcaacagatgctattttacagagagttataaggcaggagttcaaaaactgcacggtcataacaatagctcacagagttcccacggttacagatagtgacatggtcatggtcctctcttatggaaacttgattgaatacgatgaaccttcaaaacttatggaaagtaactcatatttctctaagcttgtgggtgaatactggtctagttgcaggagaagttctcttcaaaatctccaacactag

SEQ ID NO: 240 - DNA, 1500 bp, Papaver somniferum
atgatttcatcaatgtcagaaaagaacatgcaaccttcaaagctccttttctacctcatattcacttccatgttttttctgattctttcttctattatccttcttcaatcaagtagtaattcattcatgccgagatcagttttcaggctaatcgtagttaatactacctcatctgagtatttcagaagaaatgtcaacagttatagtaaagacacttttgatcggtcttctctgccttcttcaattgatactagaataactgagttcgaaagttcttcgtctcacggtattggtgtattaggtcaagagaatgcaaaagtatgtaaatgtaatcaatctctcctgaaggtttatatgtatgatttgcccccggaatttcactttggtttgttaggctggaaaggggaagggaatcaagtatggcctgatgttagtaccctggatcagattccgaggtaccctggcgggttgaatttgcagcacagtattgagtactggctcgccttggatctgcttgcatcgaccactccaaatgttgcaaggccttgtagtgcagttagagtgcagaactcaagtttggcagatgtgatttttgttccgttcttctcgtcattgagctacaacaggcaatccaaattacatggaaaaaaagagaaagtaagtgtgaatagacagctgcaggataaattggttgagttcttgatgagtaggcctgagtggaagaaagaaggtggaaaaaatcatcttattgttgctcaccatccaaacagcatgttgggtgttagaaggaagctgggctcggctatgtttgttcttgcagattttgggagatacccagctgaagtggcaaatctggataaagacataattgctccttacaagcacatcgtgagaatgattggtgtcaataactctgccccatttgagaaaaggccaatcttggcgtattttcaaggtgcaatatataggaaggatgttggagtcattcgacaagaactctattatctactcaaagacgagaaggatgttcactttgcattcggtactgtccgtggaaacggggttcataaggcaagtgaaggaatggcttcctccaagttctgtcttaatattgctggagacaccccttcctcgaaccgcctttttgatgccattgtgagccactgtgttccagtgatcataagtgatgaaattgagctaccatttgaagatgtcttagattattctgggttctgtatctttgtccagacatctgatgccgtgaaaacaggatatctagtgaatctacttagagggatcaagcgtaaaaaatggacaaaaatgtggaacaggttaaaagaagtcgcaccacattttgagtatcaatatccatctgtttcaggtgatgctgtagaaatgatctgggaggcagcttcacgaaagatgcattctgctcggttaagacttcataagacaaacagatataaaaggtaccagctgatgggaatggtaaagaaatag

SEQ ID NO: 241 - DNA, 612 bp, Papaver somniferum
atggcagaagtagtttcagagattccacaagaaaccatggaagttgaaactcctcaaaacggttctgaaacaaacggtgattccaaacgatctagagaaaacaatggtgttgaagataatgaagcagccaagaagcagaaggtagaagaagatgaaactgaagggggcgaggagaaaaaatctgaacctgttcaactcggacctaagactttcaacacttctgttgaaatgtttgattatttctacaagttccttcattattggcctcctaatttggatgttaacaagtatgagtgcatggttttgctcgacttgatcaagaagggtcattcagagtcggacaagaaggttggtgcaggagtaaaagcattccaagtccgttaccaccctatgtggaaaagccgatgttactttctgatcagggaagatgaatccgttgacgatttcagcttcaggaagtgtgtcgaccacattcttcctttgcctgaaaacatgaaactaaagccagaagcaaataaggcattgggtggcagaggaggtggaggcagaggtggtggtggccgtggaagaggcggccgtggtcgtggacgaggcaactggaataggaactga

SEQ ID NO: 242 - DNA, 1218 bp, Papaver somniferum
atgcctgaccggttgtctagaatcgcggtgctcaatcccgaccgctgcaaacctaacaagtgccggcaagaatgcaaaaagtcttgccctgttgttaaaactggtaaactttgtattgaagttactagtagttctaagttagcatcaatttctgaagaattatgcattgggtgtggtatttgtgtcaagaaatgcccatttgaagcaattgatattatcaacttgccaagagatttggataaagagacaacgcatcgctatggccccaatacattcaaattgcacaggttaccagttccaaggcctggacaagttcttggtttagtgggaacaaatggaattggaaagtctactgcgcttaaagtgttgagtgggaaattgatacctaatttgggcaaatttgataacccacctagctggcagcaaatattggactacttcagaggaaatgagcttcagaactatttcactcgaatgcgtaacgaaaagttaaaggcaaaatgcaagcgccaatatttggatgacatcccaagaatggttaaagggaatgtggggcaagtgctggagcaaaatgatgagagaaatgtcaaagaggaactctgtcttgatcttgagttgaaccaggttacagatcgaaatgttggtgatttatccggtggtgagctgcagagattcgctatcgctgcggttgccatgcagagcgcagatatttacatgtttgacgagccatccagttttcttgatgtgaagcagaggcttaaagctgctcaagtaatccgaacgttgctcaggccaaatagttatgtcattgttgtggagcatgaccttagtgttttggattacttatcggacttcatttgctgcttatatgggaaacctggagcatatggagttgtcacccttcccttttctgtcagagagggaattaatattttcttggctggctttgtccctactgagaatctacgattccgtgatgaatcacttacttttaaggttgcggagactccggaggaaagtgcagaagaaattcagtcgtatgcacgatacaaataccctacaatgagtaaaactcaaggaaattttaagcttcaaatcatggagggagaattcactgattctcaggttgtcgttatgcttggtgaaaatgggacagggaagacaacatttatgatttatccgcaggctagtatgccttctagatcctttattctatga

SEQ ID NO: 243 - DNA, 798 bp, Papaver somniferum; identical to SEQ ID NO: 54

SEQ ID NO: 244 - DNA, 903 bp, Papaver somniferum; identical to SEQ ID NO: 218

SEQ ID NO: 245 - DNA, 234 bp, Papaver somniferum
atgcttgctgattatggaattgacactggcataatgaagatcttttgtgataactcaagtacgattcgcatcactgagaatcatgttgagcactcaagaactaagcacattgatataaggaatcattttattagagatctctatgaaaatggtatcatcaatatggaatttgtgccttcagaacaacaattgactaatatcctcaccaaacctttagacactgctacgttttaa

SEQ ID NO: 246 - DNA, 987 bp, Papaver somniferum
atgacaatggtttcccaagaagctatcgagaagttgcttgatttgatggaagaagttgaagaacctttaaagaaaagttttcagaatatgcatcaaggatatccaaatgaaagtttggtgcggtttctcaaggctagagacgggaatgtctacaaagcgcataagatgctaattgattgcttgacctggagggtggaaaatgagattgataagatattaacgaaaccaattgttcccactgacttgtatagaggtgtgcgggattcccagctactaggattgtcaggttactcaaaagggggccttcctgtctttgctattggtgttgggcaaagtacatttgacaaagctttggtccattattatgtccagtcacatatccaaatcaatgaatatcgtgaccgtgttgtgctgcctcatgcaacaaagaagtgtgaacgctatattgggacctgtctgaaggttttggatatgactggtttaaagctttccgcactcagccatataaagctactgactgtaatatctactgttgatgaactcaattacccggagaaaaccgatgtatattacatcgtaaatgccccatatatattttcatcatgttggaagattgtgaagcctcttttgcaagaacgaacaaggaagaaaattcaggtgctccaagggagtgggaaagaagagttattgaaggtaatggacaaggaatcactccctcatttctgtaggagagaaggttcatctctccgttcaaacccgagcaactgcttctccatggatcatgcgttccaccaacagctttatcattacatcaagcagcaatctatgaggagtcctaccaaacaaagaccattccacgtaacgttaccagaaccaaactcagaagaaaaatatattgccaaaactatagaacacgagttccacaattttggtaagcgaaacggtctctctcattcatttgagggtctggaaatcaacgtcgagtga

SEQ ID NO: 247 - DNA, 1314 bp, Papaver somniferum
atggctagcagcagcaacagagacgaaccgctttctttcatgaacccttcttcttcttcatcaccaattcaagtttcagattatcttggggttgaaggtctaaattctcagattggaagcgcttctggaagctttcaaaacgaaggatttcttacaacaggaggaggagatgctggaagtggaagtaatagcgatattgagtttggtttcttgcgccctgaatttgggcagacttctttagttggttcagtacagatctatgaccgccatgtcttcttatgttataaaaatccacaagtatggcctcctcatgttgaagcggcggaatttgatcgattgcctagacttctttgtgcttctcttttggctagaaaggctgagatgaagaaacagactcggctaacaatatgtgaggggcacgatggtaccgagacatcaaatggggatattttgatcttccctgacatgattagatacaggcgactgacacattttgatgtggatacatttgttgaagaagttctagtgaaagacaacgaatggctgcctggaacacccgaggcactgtcaggtacatatgtctttgtgtgctctcatggaagtcgggatcgtcgatgtggtgtctgtggacctgcattgattgcacgatttaaagaagagattgacttacggggtgtccaaggtgtgtctgttagcccctgttcacacattgggggacacaagtacgctggaaatgtgattatattcagtcgaaatagcgatggaatggttagcggtcagtggtatgggtatgttgccccagatgatgtacctcttttgcttgagcagcatattgggaatggagaaattatagacagactttggaggggtcagatgggtttatccgtaaacgaccaaaagcgcgatcaagagctaaggctgcaactaaacaataaagccaactacgaaaatataataagagaaccggttgatgattatgaggttgaaccaaatggcacttcctatgagactgcaggttgttgtcaaggcaatgaaagctcttcgtgttgtcaagtaccagaaaggatagaacgaaacaatcacgtcgtgaacgaggaggtgaaatttcctaaagaaaagaagataaagaagggcactgacaagaaactgcttcgaactagtagtggcaagggtactactagcacaagaaaagtttgtgcaatgccaacatggtttgaaagttgggaacgggaagatacctatgctgctcttgctgttgtcggggcttttgtttcagttgccattgcatatagttcttataagcaactgagatga

SEQ ID NO: 248 - DNA, 2016 bp, Papaver somniferum
atgggcaaaaaaacttatgacagtccaaaagattctccacggatggaggtaggagagatagacaccagggcaccatttgcctctgtcaaagctgctgttagcttgtttggtgaagcagccttctcaggctcgggtgagaagcctgtcattaagaaatcaaaacttccttctacagagagagtgttggtgaaggagacacagctccacttggcacaaaaggaattgaacaagttcaaggaacagctgaaaaatgctgaaaccaccaaggctcaagcacttaatgaacttgaaaaagccaaaagaacagttgatgacctgacacagaagctaaagacaataaatgagtctaaagagtcagcaatcaaggcaacagaagctgccaggaatcaggccaagcaacttgaagaagcaactgctggaaattctctacaatccaatgctgcttgggaacatgatctagatagtgctagagaacagtacacacttgccctttctgaacttaatgttgcaaagcaagaactcactaaaatacgccaggattatgaggtgtcaatggaagcgaaagctgctgctttcaagcaagctgcagaagctgaaaactcagccaaagctaacacagagagggcatctgagatatctaaggagatttcagctgcagaggagtcactggtggatgttaaacatgctgcaatgcaggcccagcaagaaagagttaacattctatctggaaaagaggctcagcgccaatcttatgcgtctgctctaaaagaagcagagaacaagttggaatcattcaagaaaggatttgatcccactcttcctgggagtctggaggctaagctggctgaaactgatgctgagattggtgctctgaaaaaagaaatggaaaatgcaaaggcttctgatctggattctgttaaatttgttacgttggagcttgatgatgctaaagagtcactacaaaaagtagccgaggaagagaactcccttcgaagcctcgtggagtcatgtaagaccgagctagagaaagtgaagaaggagcattctgaactgaaagagaaagaagctgtgactgaatctattgctgggagtctgcacgtgcagctgcgtatatgtaaagctgaacttgaggcagctcttgcagaagaaagcaaagcaaaagatgcttctgatgaactggtcacaaccatccaacagctgtcattggagtctgaaaacgctagaacagaagcagaacagatgaaaaagaatgtggaagacttgaaaaaagaagccgaagaaaccagacatgctttagaagaagcaaagaaaaaactagagacagctttgaatgaggctgaggaagccaaagcggccgagaccaaagctctaggtcagattaaggttttatcagaaagaactaatgctgcccgggcctcaacttcagagtctggtgcaaagatcactctctcgaccgaggaatttgaatccttaaataggaaagttgaggaatctgatgtgttagctgaaatgaaaatagctgcagcaatcgcacaggtggaagccataaaagagagtgagaaggaagctcaaaggaagttggagacaaattggaaggagattgaggagataaaagttgcaacagaagaagctacaaaaagagcagagatggctgagatggcaaagaaagcaatagagggagagcttcgcagatggagggaaagagagcaaaagagagctgctgaagctgcaagccgaattctagcagaaacagaagctgcctcatctcctgattcatccccagctcctccatttcagcccaagctcatgaagaagcagccatcagagaagaaatcatccccagtgaatgagaagtttcagaaggcattttcagagaagattagtaagtcacgaaagtttgataaaaacaatggatccaaaaagctcttgccttctctgagtggcatctttcataaaaagaagaaccaagtcgaaggtgggtcaccgtcttatcttccaggcgagaatccggtatga

SEQ ID NO: 249 - DNA, 347 bp, Papaver somniferum
gctatacctaccttggatgaagttaaagaggctgtttttgatcttggagcggattctgctcctggccctgatggatttacaggttctttctttcgaatctgttggaacattatttctagagacctttttaatgctattgcaaactgttgggcgatgagcaagattcctaatggcattaactctagttttattgtgctcattccaaaaactaataagtctgatgctattaaagactataggccaattggcttaagcaacttcttcttcaaaatcattacaaaaattatggcgaccagacttggcacggtgttgaacaaattgatttctgaagagcaagtggcgtttat

SEQ ID NO: 250 - DNA, 429 bp, Papaver somniferum
atgagctttagtagtacatgctgctcacaaatgaactgtagatttggtacatccgaactgttctccccatgctttgcgttaggtcgatttccatttctgtcctgcatgttgtcccgtgaacttgctagctggttttgtctgctagaactgcacctgcctaacaaagagatacttctggatgacaacaaactgaaagataacaagacttctatggacactaagttttcaaattatttcgtccctgtacttccatccgtaacagagtgtaacatcataatgcagggagtcatgatgactcatggcaacattgtatcaacagcagcagcagtcatgacagttataccagaaataggccgcaaagatgtttacttggcgtatttacccttggctcatgtttttgagctggaagccgaggtccttacatgttag

SEQ ID NO: 251 - DNA, 2037 bp, Papaver somniferum
atggatgcacccaatgatgggacattctataaaccatttgtcggaatggaatttgactctcttgatgagtcatatttttactacaatgaatatgctagggctgttggtttcagcattcgaagagccaaaaaccgtaggtcaaatatagacggagctcttatatttcagcgattttgttgttctaaggaaggtcatcgcagaaagaggcgtgataatgatgacgaggaaccaaagaaaatgaaagatggtgtcttagtaaaggtgagaagacgaaatgtaaggtctataagagtgggttgcagtgccaagttggatgtcaaaagggttactgatggtaaatgggttgtgcgtaaatttgacgaagaacacaaccatgaatgtgctaattcaggggaaaagcatatgctgaggtctcaaagacgcattcaatctattcaagtagacatgagcatgagtgactgtaagataaagaaaccagaaaaaggagatgtaagggcacttctaaattactttagggaaatgcaaaccgagagtccatccttcttttatgccatacaaggtggtaaagatgatcgaatgttaaacttcttttgggttgatacgagatcaaggatggattatgggtacttcggtgatgtggtctatttcaagagtaactatgggatcaacaagtacggacgggcattttcaccgattctaggtataaatcatcaccttcagacagttttatttggttgtgcaatattattgaacgagaatgaggagtccttaacatggctattggagacatttttgaaagccatgtctggacgtcgtccagttgcaatagttattgatggagatgcagcaatgatgaaagcaattgagcaagttttaccaggtacccgtcagagtttatgtttaggggagattctcgtggatgcttccaatcattttagtcatttggaaaatatgagggatgcatttattacagatttgaagaaatgtatctatgatacacaatggtgtgatgaatttgagtcaagttgggtattgttacatgaaaaatacaagcttcatgaaaatgagtggctggataatttgtacaagaaacggcacatgtgggctccagtgtactcgaggcatgttttccacgcaaatatgatgacgattcaatgcatcgagagtataaattcttacttcgatggattcgtgaatgagccacttcctctttatgagtttctcaagcagtatgacaaggcgcttgatcatagacgggatgaggaaatatccgaagattttcagtctcttgaaacacggcctgttttgaagttagatgttccaatggaacaacaagctgctgatctgtacacaagatcagtctttaaagagttccataaggagttttgtgagagttttagctacattgctgaagaaacagcaagggtaggaacaaattggacatatgcggtgtcaaggtggggtcaaaataggagctgccttgttagtttcagctcttgtaataatgacatacgagtgaattgtgattgtcagaattttgagttcacgggcattctttgtaagcatatttttaaagtcttcactgtgcggaatattatgttggttccagatgtctacatcaggaaaaggtggacaaaaaaggcaaaagtcggggttttcttgggtgaaggatgtaggaaagcgctagaagactgtcagaaatctcaagccttccgctttaacgatctttgccaactcacttttaatctttgtgctaagtctgcaatatcaataaatgcttaccaaactgcgaaatctactatggagatgataattggagagctggacaaagaagccgaggaagaggtgagtattactcaacctaacatagatcacgtaagtaatttgcattatcccattgatgctgttaatggtattggaagttccgatcacctaatgggtgaggataatcagacattgacttcaggtaaccatgttacaatgcaaaatccccaaagggttggggataccagaactgggttctggttacgtctttag

SEQ ID NO: 252 - DNA, 507 bp, Papaver somniferum
atggatatatcttctgatctgactgagcttggaaggtctccggttgcagtaatatctgccggtatcaaatcaatattagatattccaagaactttggaatatttggaaacacaaggtgttacagttgcgtcttataagacccatgagttcccagcattttttacagaaacaagtggctgccaggtgccgtgtcgtgtagattctcccgaagactgcgctcggcttatagatgccaacctgaaactcggacttggatctggcatcctaattggtgttccaataccgaaagaacatgctgcttcaggaagaatgatagaatctgcaatacaaactgccctaaaagaagcaagggacaaaaatgtgtctggaaatgctgaaacaccttttttgctcgcaaaagtgaacgaactaactaaaggtgcctcactggcatcaaatattgcacttgtgaagaacaacgcacttgttggcggaagcattgctgctgctctttctaaactcagatga

SEQ ID NO: 253 - DNA, 921 bp, Papaver somniferum; identical to SEQ ID NO: 215

SEQ ID NO: 254 - DNA, 636 bp, Papaver somniferum
atggaatgtctgtcgtccaaatttattccttttgcattgttggccattttatcactcctacaagtagcagttgggattagatttgtgattgacagggaggaatgcttttctcattcggttccatacgaaggggatactgtccatgtttcttttgttgtgattaaagctgagggatggcattatggtgacgatggtgtagatctagttgttaaaggaccaactgaagaacaaattcatgatgctcgtgataaaacaagtgagaagtttgagtttgtggctcacaagaaaggggtccataaattctgcttcaccaacaagtctccttatcatgaaaccctagactttgatattcatgtcggacattttacatactttgaacagcacgctaaagatgagcacttcaaccccttgctggaacaaatttctaaattagaggaagctctttacaacatccagtttgaacagcattggttagaagctacaactgatcgtcaagcactagttaacgaaggaatgagcagaagggcaattcacaaagccatctttgaatctgcagcacttgtgggagctagcattctacaagtgtacctcctgcgccgcttgtttgagagaaagcttggcacatccagagtttag

SEQ ID NO: 255 - DNA, 957 bp, Papaver somniferum
atggctcaattactgagtcctgtttgtacagatttactcaaattccaaaaccctaataatcaattcttcagttcaattaaaccatggcgaatgttaacaaagatcaatagcaaccatttgataacaacatttagtggttcaaaacggcgtgactctagaattagagctgttgctgaagaatccttttctagtgatgcaattgcagatgattattatgccgttttaggactgctaccagatgcaacaccagagcaaataaagaaagcttattatacttgcatgaaagcttgccatccagatttgagtggaaatgatccagagacgactaatttctgcatgtttatcaacgaagtctacacggtacttagtgatcctgtgcagcgaatggtttatgatgagatccatggatatgcattgtcagcagtaaatcctttcttggatgacactagtgttaaggatcatgcttttgtggatgagtttagttgcataggttgtaaaaattgcgccaatgtcgcccccgatgtatttaatatagaagaagaatttggaagagctagagtctgcaaccaatccggcaatattgacttggttaaccaagctattgaaagttgccctgttgactgtattcattggacttctgctgcacaagtatctttactcgaagatgaaatgcgcctggttgaaagagtaactgttgcactgatgcttgctggaatgggaacttcctccgatgttttcagaatggcaaacaaccgttgggaaaagcgccaatccaaagtcttggaaaaggctagaataaggatgatgcagcaaaaagatgcaaataaatctgaaacatactggaatgacctttggggaaagcctgcaacctatgaaacttcaggtattaagaataaaacacaccaaatcttatttttcgaggttttctcgcttcctagttttatctctttcacctga

SEQ ID NO: 256 - DNA, 1575 bp, Papaver somniferum
atgggtagtcttccaactgataaccccgaaagcatgtcgatatgtttgcagaatccacttgatccagatgagttcagaaggcaaggtcacatgatcatagattttcttgctgattactacaaaaatgttgagaattatccggttagaagccaagttgaactaggttacttacgcaaacgattgcccgaatcagctccgaacgatcctgaatctattgaaaccattcttcaagatgtcacaaatgatattatccctggtcttactcattggcagagtccaaactactttgcttactttccttctagtggttccgttgctgggttccttggtgaaatgctcagtaccggatttaatgttgtggggttcaattggatgtcttcaccggccgcaactgagctagagagtattgttatgaattggctaggccaaatgcttacacttccaaaatcatttctcttctcgtcagatggaagttcaggaggaggtggggttttacaaggaaccacttgtgaagccattttatgcacactaagtgcagcaagagataaaatgttgaataaaactggtagagaaaatattaataagctggttgtttatgcttctgatcaaactcattgtgcactgcaaaaagcagctcagattgccggtataaacccaaagaacttccgcgcaatctctacctcaaaggctacaaacttcgggctctctcccaattctcttcaatctacgattcttgctgatattgaaaccggattagttccattatttctatgtgctaccgtcggtacaacttcatcaacagcagtggatccaattggtccactttgcgaggttgcaaaactgtacggtatttgggttcacgtggatgcggcgtatgctggaagtgcttgtatctgcccagagttcaggcacttcattgcaggtgtggaggaggcggactcatttagtctaaatgcacacaagtggttcttcactactttagactgttgttgtttatgggttaaagactctagtgcccttgtgaaggcattatcaacgaatccagagtatctaaagaacaaagcaacagaatcaaaacaagttatcgattacaaggattggcaaatagctctaagcagaagatttcgatcgatgaaactttggttagtacttcgtagctacggaatggccaacttgagaactttccttaggagtcatgttaaaatggctaagcattttcaagggctcatcggtatggataacaggtttgaaattgtggttcctcgaacttttgccatggtttgttttcgccttaaaccaactgcaattttcaagcaaacactagtcgaaaacgattacattgaagctgcgtcaaatgagatcaacgggaaactgcttgaatcagtcaatgcgtctggcaggatatatatgactcatgcagttgttggaggggtttacatgattcggtttgctgtgggtgcaacactgacagaggaaagacatgtaactggggcatggaaggtggtacaagagcatacaaattacatacttggtgcgttggatggtcatactaccaatcatcagatcgtggcttaa

SEQ ID NO: 257 - DNA, 224 bp, Papaver somniferum
atgcctgctgattacagttcgatttcaagtcttattaagaaatctagaaatgacgaggagaaccaaactagggtttctgttgcgacgatgtctttaggtgatgaaaattcacatgaaattgatggggatttgcatagtagacaacttgttgtttatggaagagaaactatgcggagactttttgcttccaatatccttgtttctgggatgcaaggtatcggtgc

SEQ ID NO: 258 - DNA, 955 bp, Papaver somniferum
atggttatgccgtttggattgtccaatgcgcctagtacattcatgcgtataatgaatcaagttctcaggccccttatcggtacttttgtggtcgtttatttcgacgatattcttatttatagtgttgatatgaacatgcattttcaacatcttcgagaagtgcttccaactctacgtcgggaaaaattatttgcagccatcaagaagtgttcattcatgactgaccaaattctatttctcggctatgtcgtaaccaaggatggaataaaggtagattattccaaggttgaagctgtaagaaattggaccacacccactacactgcacgaggtaaggagttttcatggtttcgcttctttttaccggcgttttattcatcacttcagcaccattatggcacccattactgaatgcatgaaagtaggaaagttctcatggtctgaggaagctgacaaagcctttgaagcagtcaagacaaaactaataaccgcaccactattggtgttacctgatttcagcaagccatttgaattacactgtgatgcatcgaaggtgggaattggagctgttttgagtcaggaaggacgacctgtagcatattttagtgagaagttgaatggtgctaagaccaactacagtacttatgatgtggagttttatgccatagttcaagccttgaagcattggcgacactatctaattcataacgaattcattatgttttctgaccatgattctttaaggcatatcaataggcaagagaagctttcatctagacatggtaagtgggcttcttatttgcaagagttcacttttatactgaagcacaaagctgggtcgcagaatcaagttgctgatgctttaagccgtcgaagtatgttactcaacaccatgcgaactgaggtaatagattttgattcgtattctgaacatattctaaccaatccacactttg

SEQ ID NO: 259 - DNA, 232 bp, Papaver somniferum
atgacgatagataaaacgcttccgctgcaaaccagcaccaacaacaccaatgttccgaagaatccagcatcaataaatcagaaaggaaaaacaatcgaagagatgtatcaaaagaaaagtcagctagaacacattctcttacgtcctgatacatatattggttcgattgagaaacacacacagagtttatgggtttttgaaggaggtcagatggtttacagaccggtgagtt

SEQ ID NO: 260 - DNA, 510 bp, Papaver somniferum
atgtctggcatagaagaatcggttgctcctccaccaccacaagatgtttcgagtttctccaagggtgccgtaacagtcacgccaactatctttccgaatatgaaaaaactgcatttaaatgatatcaatggcagtgcagtaagttcaattttgaccaacctgacttctcttgctcatcttagtataacagaagttccagagctctttatccaacaaggattatttggtaacaacaatcttcttgaaagcttatcagtcagacgctgcaccgattttcaaggtttttgttcacttgaggaagagaaagaaccaatctctacttttcacctaaacaacaactctctaaaagaactggagttcattgattgcccagatctgacatttctgctggatattcgtggctgcacgtctctgcagaaaatcactatcaatggttgcaaggaattgaagttcgaatatgatctgcggacatgcctgtcctttattccagagctagacattcctttttga

SEQ ID NO: 261 - DNA, 1206 bp, Papaver somniferum
atgtatgtcttagccacagatatcgggtctcttcaaaatctagtgtccgttcgttttcaacatacctctatcaaagaattacccaatagttttggagaattgacaaaattaaggtcacttagtttggaagatactgatgtaaaagaattgccagagtctttgagtagcagcatttgtaaattagagtttgtgaactttggaagagtttgtaagtttcccaaagacattaagaaatgggtggatttgagatgcatgcgtaagtctaacaggtttgctgatcagtatcaagtgatgcctacaggaattgaaatgctaactcgcctggaggtcttagattcttacgtggttaggaatgaaaaggactacatcggaggatactatgattctagcaggatcgaagaactagcaggtctaaacacccttcgggaattaactataactcatctgcacaatgtgataggtaagatggatgccgagggtgcaaagctgaaagataagatgatcattaaaaagttgtatctgaaatgggtacagaaaagaaaagaagaagaagaggttgctgacagttcctttatggtgttggaaggtctaaagccacattctaatctagagctgttgtcgatagaatatttcgggggtgtaaagcttcctaagtggatgagttcttcttattgcctgccgaatttggtgaagttatttttcaaggattgcaagagttgtgagaagcttcaatctctgggtatgctccggtgcctttgcatacttcacatgataggaatgagctccgtgaaatgtttgggtgtagaattttattaccaacaaggagaagaagaagaaagcagtatgacaacattattcccttcgctaattgaattgagaattcattatttgaatgatttagaagaatgggttgctccaccaccaccttacagttccttccctgtactcgagtatctgtctatccagaggtgcccgaaactgaaatctataccggatttaggattacgcacttctctacagagaaagatattggaatgcaacaagttggaggagtcaatgccgtgtgatccgaagaacccctcctgtctagaatttcttgatgaactgagtaggggtaattttatagattttaatgatcctaaaaatggggttccttccgatctagaaaaaagaaaagaggtgggagataggtgtgctcccatgtag

SEQ ID NO: 262 - skipped

SEQ ID NO: 263 - DNA, 1161 bp, Papaver somniferum
atgaacaatatcttcgcgaaattgagaaatttagatgcgtatccaaagatcaatgaagatttctacagcagaacactttccggtggtgttattacagttatttcatctatcttaatgatattgcttttcatttctgaactcagattatatatcaattcaatgactcatacggaacttgttgtagacacatctagaggagaaactcttcgtatcaattttgatgtcacttttccagcccttccgtgttcgattctcagtcttgatgcgatggatattagcggggaacaacatcttgatgtgaaacatgatgtaatcaagaataggatagatgccaatggaaatataattgagacgaagaaggatggcgttggtgtacataagatggaaaagccgttgcagaaacatggtggcaggcttgaacacaatgagacatattgtggttcatgttatggcgcagaaacaacggacgcagattgttgtaactcgtgtgaagaagttcgtgaagcatataggaagaaaggttgggggatgtcaaatccagatgagattgaccagtgcaaaagagaaggtttcctccaaaagattaaagatgaagaaggcgaaggatgcaatatttatggattcttagaggtgaataaggtggctggaaattttcattttgcgcctgggaagagtttccagcagtcaaatgttcatgtacacgatgtgacggcttttcagaaggattcctttaatataagtcacaaaatcaataaattatcttttggagaatctttccctggtgttgtgaatccgcttgatcgggtacagtggacgcaaaagactcctactgggatgtttcaatattttgtcaaggttgttcctacggtttacacagacataaacaatcacactatccaatcaaatcagttttctgtaacagagcatttcagacacgcaatagttggtcaacctcattcagtaccgggtgtattcttcttttacgacttatctccaatcaaggttactttcacggagcaacatgtgtcattcttacattttctaacaaatatttgtgcaatagttggaggtatgttcacagtttctggtatattagattcgttcatatatcatggtcagaaagtgataagaaagaaaatggaaataggaaagtttagttag

SEQ ID NO: 264 - DNA, 975 bp, Papaver somniferum
atggcacccaaaccttccaaggctgagaagaagatcgcttatgataagaaactctgcaagtttcttgatgaatatggtcagatcttagttgttgctgcagacaatgttggatcgaaccagttacaaaacatcaggaaaggtttgcgtggcgattcagttgttttgatgggaaaaaacactatgatgaagagaactgttcgtcttcatgctgagaaaactggaaacaatgatttccttaacctcattcctcttcttgtgggaaacgttgggttgatctttactaaaggagatttgaaggaagttagtgaagaagtcagcaaatataaggttggagcccctgctcgtgttggacttgttgctcctatcgatgttattgtaccaccaggcaacacaggattggatccatcacaaacatcctttttccaggttctcaacattccaaccaagattaacaagggaaccgtcgaaattacaatcccagttgagcttatcaagaaaggtgacaaagtgggttcttccgaagctgctttgctatcaaagctaggcataaggccgttttcttatggtctcgttgtactctcggtgtatgacaatggttcagtctttaacccagaggtgcttgaccttactgatgacgatctagttgagaagttttatgccggtgtatcgatggttacttcactctcattggctctctcgtaccctacccttgctgctgtacctcacatgtttgtcaatggatacaagaatgttctttctgtcgctgttgccagtgaatactccttctcttatgctgataaagtgaaagaatacttgaaggatccaagcaagtttgcagttgcagctgctccagttgctgcggctgctgcttctggtggtgcaccagctgctgcttcaaaggcagaagagaagaagccagagcctgaagaagagtctgatgaggatattggggggctgtttggtgacgacgattga

SEQ ID NO: 265 - DNA, 789 bp, Papaver somniferum
atggatgtcgagttgccattggagaagctgtttaaggaacccattgatgatggaaagggtgttgttgttttagtagcaaatggaagtttcaatcctccgactttcatgcatttgcgaatgtttgaactggcaagagatgcattaaattcagatggattttgtgttattggaggttacatgtcacctgtgaatgatgcgtacaagaagaaaggtctcatctctgctgaacatcgcttacagttgtgtgagcttgcttgtagaagctcgtcgtttgttatggtggatccgtgggaggcgaaacaaagtagttatcagcggactttgactgtattggatagagtacagagttgcttgtgtgatagtgggttggtgaggagagagtcgcttaaggttatgcttctatgtggttctgatttagtggaatcgttttgtgtaccgggagtatggatccctgagcagattagggccttatgtagagattatggaattgtttgtattcgcagggaaggtactgacattgagaagattatttcaggggatgagattttgaatgcgtataagaacaacattagagttgtggatgaactgataccgaaccagattagttcttcaagaatgagggaatgtatttcaagaggattatcaataaagtatctgacggtagatgaagtgattgattatatcagacaacacaatttgtacctgaatttggatttaactgaaaagaagcacttgcaagaggggaaggatgaaaagttgatgcttaaaaagaaagaaacatcagattga

SEQ ID NO: 266 - DNA, 485 bp, Papaver somniferum
atgtgcgtgttgcaatctgaagatggacatataatggatgcaccttggaagtcacagatcgactccttccctgcactgaacatcaatttaacacaaacctatattccaattcattcacaagcattaaatcacacattgattcatgactgcacttcaagcttcaacaaaatccatggcagcaacatcttcttcttcactactgatttagctatcaagaaccaaccaaaactctcacaaattcgaatcccgttaaaacccaactcatatttcttcttaactcttaatccttcacttcagattctctcaattcatctcctctttcatttctgttcgtcttctaattcatggcagtacatagctggtaacgaacagtttgaccaatcaataacctctccagacccttggcagatgagccttgaacaatggcttgccggtgtagaatacggctgcagtgcggataccttagttgtgaggaagaaatctgg

SEQ ID NO: 267 - DNA, 460 bp, Papaver somniferum
atggaggttaaccgtcgtgttgataatggagaagagccccaaaaagaagattccgaggatgatgaacctttggaaaatattgataatgatagtgctactaactcaactcatgatcataatgatcattctcctattcaaaaggaagaagtcgagtctagaaacactacaattattgatggtaagacttatgttgtgtatgagagcgatgatgattatgacttctttgtgcagtctaccccaaattcagaaatcgtcgatactttgaatgagaagtcaacttgtgaagaacgtaaggattacgataatttgcttatggaagattctgatttcttttccaataaggaagacttggttatagaagaaaccaatgaatgtcttgccaagagtttgactgagaatgatgatacttgtgatgtgagaatggaagtgtccagcagtgccgaggacctcgaaatacaag

SEQ ID NO: 268 - DNA, 539 bp, Papaver somniferum
atgtcaaatcatcgtactacacgagaacgtggcatcccacacggaagggacgaagtccttgacgagcaaaggccaggtcggagtaattcaagaagagctgaagatgctagagacgatcatcaaagtcatgatcaccataatggtagttattatgatcgttatgtacccgaagatgatgactactatttgattgatcaagacaggcgagcaaggccaagtcataagagacatgacgggcatagacacagagttggtcacgacgacaacgactactcaaagaaaactaggcgtgaaagagattatcgagaaagaagaactgaacttgtcaggaatgagcggatccgtagagaaactgacggagattcaccacgaagcaatcacctcagtaaaaagaaaatcgacgaaatgattgaagaagcgttgtcacataaacagtccaaggatgagagacaacaaatcttatcaatgaagagatcgatggattcaccgtttactaacaggataaagcagtttcgaccacctctgaatttcatcctgcc

SEQ ID NO: 269 - DNA, 1161 bp, Papaver somniferum
atgttgtcggatgcattctttgagcagtacaaaattaatctcggaaataagaaaggaaggagccattttttcttgttacacagagaagccggtgaaagtcttattgattttactaggaggtttcgccaggaagttagtgaagtcggaaaagtagatgctggactcgtaatagaggcatacaaaaatgcgctggattacgatgagttagaaatttacaattccgtaacagtccaaccagtcggaactctcaaagagttatatgacagggcagacaggtatggtggagctgagaaagaaaagagggcaaagttgtcacgtatgacaaaagctccatgtgccgaaggacatggcaaacaaaaacaacatttagagagtagttcgaagaagaaaaatcatgatgacccccgaagtagagctggagacggagaagaattaagaaaagctcagggtaaggtgaaaattagatttcccagtctaaatatcggactgggggaactcttcaaaaagatcaaggactctcttccagttccaaaaccaatgtcagaacaaataaaggataaaagagataaaagtatatattatgctcatcatcgagatcacgggcacaataccgagtcttgtcgaactctggcaacagaagttcagaaaatgatcgacgaaggaaagcttcaacagtatgtgaagaagaatccatcacaagtgaatacattagatctccgagaaatcagagtgagtcatgcaagagtcaattcaacttcaaggaaggctcatgagaatgcaacacgtctgaagctgcgccatatccaggattggcggatttcgaataaggttgactatgctaatcttatcggtacggaaactctagagaaaggaaagatagagatatgtttttcagttgctgatcttgctggagtttaccaaccacataacgatgcaattgttatcttagctctcattggaatgtacaaggtacgtcgagttctagtcgatactggaagttcaattagcgtcatattctccggagcatacacatcaatgagcttgaatgaaagtcaagttgaagctgatgataatcccattatcggctttagcggagagataatgacaacaataggaagagtaagtttgcctataactgggggaggaaaaacggttatgtaa

SEQ ID NO: 270 - DNA, 375 bp, Papaver somniferum
atgacaagaactactcatgtcgactcttggtggtggctgcgaagatgccctcctaatgaaattcaatacttattaaggacatgccagagcctcttgaagggaaaatacatcaagtttgttgaagaagcagatggcatctctacaactcaggaaaaggactttttaaagttaatgaagctcaagtactttataagtcttgctcagccaggagaacttgttggtgttcttgctgctgagtccgtagtagagccatctagcaagatgacgtcagatacatttcttattttttcctttttctttatttatcatcatgtacgtgcatttctagtagatcgcgagatggcaaagtcgtccggagttgaatatattacttag

SEQ ID NO: 271 - DNA, 954 bp, Papaver somniferum
atggatattgatgatatggacaacggtcaatccgaagattggagacaatcgtatgttcgttacctgcggtgtgtaactcgtgatgaggggatgaaattgttagctgagacgcatgaaggttgttgtggcaatcattctggaggcaggagtttggcacataggttgctttctcaaggatacttctggccctatatgcagaacgatgcaaaggagtacacgaacaaatgcgtatcttatcagatgcatggtcctctaataaagagaccagcaaatgagctgcatccagttatgagcgcatggccattcagtaaatggggtttggatactgtaggtccgttcccagctgcacctgggggggtcaaatatctgttggttgctactaattatttcaccaagtggatagaagcagtggcacttgtaaaaatagaggcagtgcatgtccgcaggttcaattgggaaaacattgtctgcagattcggcataccagcaacgatcgtttctgataatgtgaagcaattcgactctggagttctgtgggcatatagaacgacgccaagacggtcaactggattttctccatttactctagcatacgagacaaaagctgtacttcccgtggagctattagtaccaactacaaaatctctggcggagcgttcgggtttgaactcagggattctatccaaagacagggagctccttgacgaagtaagagatgaagcttcacgaaggctagcaatatatcaacagtcaatgaagcagcagtataacaagaaagtacgcgagagatcattccttcccggagaacaagtcctagtggaaaagcttgctagctgtggtgcctactggttaaggaacatgagtggcaagatggagcccaaaccatggaattcctttaaccaattagcggagatgttggcaatcgaaacgccgagcttttggaagtacaactga

SEQ ID NO: 272 - DNA, 903 bp, Papaver somniferum
atgctagaggctaggatcatcaaacccgtcagatatcctaaatggttagcaaatattgttgcagtaccaaaaaataatgggaaaatcagagtatgcattgatttcacaaacttgaataaggcatgttcaagtgatccttatccaatgctcaggattgtcgatctagtcgattccacctcgggatacggaaggttgtcattcatggatggtttttctggttacaaccaaataccattatttggagatgatcaagagcatacatcttttataacagacaagggggtatactgctaccttgtcatgccatttggattgaagaacgcgggagctacttatcaacgtttagtaaacgaaatgtttaaggacatgatcgggaaaaccgttgaagtttacatcgacgacatggtggtcaaatccaagcagaaggaatctcatctttctgatctgaaaagaacctttgaacgactgcgacaatatggaatgaagttgaatcctgccaaatgttctttcggactcacgtccgggaagtttcttgggtatatgatgacacagagaggaattgaagccaatccagaacaaataagagcaatacaagagatgccttcacctagaagtgtgaaagaagtacaaagacttactgggagattggccgcattgagcaggtttatttctcgagcatctgacaaattcagatcattttttcaaattctaaggaaggcagagaagtttggttggagtgacgactgtgagcgtgctctaaacgaaatcaaaaggtacttgacctctcctcctgtacttacaatccccaagacgggacaaaccatctacatatatctggcttcaagtgagtttgatgtgagtgcggttttgtttgtccgagagccttggcgcatacaccattga

SEQ ID NO: 273 - DNA, 666 bp, Papaver somniferum
atgagtcaggaatcgtttatatatagttttgtcgcgagaggaacaatgatattagctgaatatacagagtttactggcaattttccagcaattgcaactcaatgtcttcaaaaacttccttctactaataacaagttcacctacaactgtgatcatcatacttttaatttccttgttgaagatggatatgcatactgtgttgttgccaaagagacggttgggaagcatgtatctatagcttttttggaacgtgtgagagcagatttcaagaagagatatggaggtggtaaagctgatactgccattgctaaaagtcttaacaaggagtttggtcctgctatgaaggaacacatgtgttacatcattgaacatgctgatgagattggaaagctatcaaaagtgcaggcacaagtttcagaagttaaaagtattatgattgagaatatagacaaggttgttgatagaggggagaaaatagacattctatccgagaaggctgcagacctgaactcaaatgcacaagaatacaagaaaaagggaacacaattgaggcgaaagctgtggtatcaaaatatgaaaatcaagctggttgttcttgcggttctcttgattctggtgttgataatatggctttctgtttgtaaaggctttgactgcacgaattag

SEQ ID NO: 274 - DNA, 389 bp, Papaver somniferum
atgtgtgtgtcatcgaatgtttggcatggtagacttggtcatgtaaattacaaatcaatgcataaactggctagcgtaggctgcatactcaaattcactttagataaaagtcataagtgtgagatttgcgtagaatctaagcatgctaagaaatcattcaggaagaatgtccagagaaacactaaacccttagaattgattcattcagacgtagttgacatgaagtcagttcaaactagaggtggtaagaaatggtttgtcacttttatagatgattgtacgaggtactgtcaggattatttgcttagagggaaggacgatgccttagaagcctttaagatatataaacgtgaagttgaaaaccaaatgaatgctaccattaaaacgtt

SEQ ID NO: 275 - DNA, 1268 bp, Papaver somniferum
atgggaaagaacgatgttgaaagaccacagaagtttaacggaaaggatttcaagagatggcaatccaagatgctattttatctaagccatcatgaactggattatgtacttgttccacatgctgaattgatgaatgctgaaggtttaactgaggaggcgatcgagtataacaagaggtgtaattttctggcgaaaaatcatatcatgaatggtttggaagatgcgatgtatgatttttacaatgctaaagaaaatttcagtgcttatgatttgtggactgcgttagaagcaaagtatcaagcggagactgcagggagcaagaaatttctggtggcgaagtttatggacttcaagatgacgaatgataaacctgttgttgatcaatttctcgaatttcaacagatcattaatgagattcttgctgaaggtatggtcattgatgagacgtttcaagtatctgcggtaattgagaagttaccatcttcttggtctgaatacaagaaaaagctaagacatgaaactggcgagatcaacatggttgaattaggaaagaaaattcaagtggaagagatgctgtgcaccaaggataagaacgtgtcttctgcaagggacatgagtaacaaagctcatatgactgaacacagatcttccaaagctggaaaaggtgagagtaacaatcgtaactctaagcgtggtcctcccaagaaaggtatgtttcgaaaaccagagtctagcattactaaaattaagggtgcttgttatgcgtgtggagttactggacatatggcagttcactgtagacatcgtaaggacaaaaaggatagtgctaacttggttgaaaagaacaaggacgagttttctgcagtagtgtctgaagttaatttggtgaccaatgtgatggactggtgggtagactctggagctaccaagcatgtttgtgggaacagagacctgttcacctcctaccagagggtaggggaaggcgagaaactctatatgggtaactcatctgcatcagaggttgcaggaaaaggaaaggtcggtctgaagctcacatctggcaagactctcacattgaatgaagttcttcatgttccagacatctgcaaaaatcttgtttcttgttctgttttagatgataagggttttaaagtttcaattgagtctggaaaacttatagtaactaagggcaatgattatgtgggtaagggttataagactggaggtctttacaaacttaatgtaacctgtcctgaagtgaaattgaa

SEQ ID NO: 276 - DNA, 885 bp, Papaver somniferum
atgacgaaaacaaggatgacctgtggggaaaaaccatgctcaatattgttttcaatggcgccagccggtcatgcaaaagatatccctatcttgataagtgatgacgatgagatggagcatgattctccttcatactctccagctactcactccaattaccactttgatgcaaatcaaatgactcagcaacccatgacagctacgtctttgaaccatcctaccattgatgatcctttgaatggtgccattaaggctaatggttcagtcacagcaactcagtcaaatgactattgtaatgcaaaccctcctattaatgcaactgaggaaaaatacccttttaacgctgacatattcataccgattccgatcaagagaaatgacaatcccatgactcatgaggattctgctattttagatccctttgtagctcgtgggttgatcgacacttctatgttacccgtcgacaggggcttgtttgactggatcgatgatacttgcgtcgttctggacaaagtgaagcagtgtagctttgagatgcaagctctccttcgccgatcacagattttgcacatgcaagaggtaaccggaaaggatgctagaatcgcagggctttgtgcaacaatagccgaaaagaatgctagaattacaaaacttcgcgatacactagttgacagaaacttggagttgtatcagaaagaacaatggttgttcgaggaatataccaggaacgagaagttggagatggaaagtaaagatgttgtcggtatcgaagaggaactaaggatcaccaaggagaagctcaaagaagctgctgagtttgcgtacaactacgatcctgaggatgacgactacgagccagaggagataagctctaaacaagaatga

SEQ ID NO: 277 - DNA, 819 bp, Papaver somniferum
atgaaggcagcaagactgattgtatttccaatcaaaggaaggaattggtgttttagtagatccattgaacaaacagttcaagaatcagaagcaacaaaaccatcaccgaaatttaaagatctttataagaaaattacttctaaggggaaacccatgaatcaaaatgttgagatcattactgaattcttctcaactaaaatgaataaagcttgggctggtcttggagaagctcctgaaggtagtatcaagaataagattcatggtttaggagtgaaactgctggctcgtgttaagccgtctgaaattttcttgaagtcgatttcaaaggatgttaccaatgtcgagattacttatccaacgagtttaaatcctcgtcttgtgcgccgaagattacgccatattgctttcaggggatctgtaattcacagacggtacttctatggttctgtttcgctgcttccactaactgctgcatgtgctattctaccactgcccaacatcccgttcttttggaccttattccgcacctattcccactggcgagctctccagggaagcgaaaggcttcttgttctagtatcagatggctcgacaactgtaaaggagcagaaaagggacagtgatgatgaagacgagcaagaacataaaagcctgaatgcacctattccacaatgggttctgcatccctctgaagaccttgataagtatctccaggacctagatgaaaaagatggtctcagcaagtccgttgtttctaaaatttgcaaagcttatcatttggacacacaggaagttgataagtatcgttgttctgtttaa

SEQ ID NO: 278 - DNA, 1374 bp, Papaver somniferum; identical to SEQ ID NO: 87

SEQ ID NO: 279 - DNA, 1740 bp, Papaver somniferum
atgcctttattagatattgctacatcacaacctactttcggaaatcatttttgcacttcttcgaggtatcagacattacttcatggtaatactacatctgttaaacttgttaattttggaaaggagaagagattgttttctacatgggaggtgtcaattcagatgccaacaaaaattaggtttgatatggggggtaatagacgaggaagagcgctgctgattaaggcagttgctacgcttgagcctaagtatttggttcagagtgcagaagatagaagtgcgaatttggaactgggttcagaggcggcttcgtctcagtatcctggtgaagaagatgaagccgaagttgatgaaagagagagattaagacggttgagaatctccaaagcaaataaagggaatgttccgtggaacaaaggcaggaaacacagtgcagagactctacgccggatccgagaaagaaccaagattgctatgcaaaatcctaaggttaagatgaagttagtgaacctgggacatgctcagagtgaagagacaaggaacaaaattggggttggagtgcgaatggggtggcaacggcgccgtgagaagttgatggtgcaagaaacctgctgttttgagtggcaaaacttgattgcagacgcttctagaagaggatatgctggggaagcagagctgcagtgggagtcgtatgaagttttggatgaacagttgaagcgagagtggttggaaagcattgagcagaggagaatggcacctagacccaaggggagcaagagggcacccaaatccctcgagcaaaggaggaaaatatcggaagccatatctgccaaatgggcagatcctagttatcgggaacgggtttgtgatgctctgaacaagtatcacggaatacctgaaggtagagagagaaagccaaggagaaagcctagtggagatagaaacgctgcgagaaggaaagcttacagtgaagctgagagtgatgctaaaagccgagcgaaacctaagaaaagtcgtgcagcaccatacaaagatccattagcggattccaagttggagatgataaggaatattagggcgcagagggctgttacagaaaccaagaaaacagaagctgtggaacgtgcaaagttattgattgcggaggctgagaaggctgctaaggccctggaggtggctgcaacaaagagtcctcttgcactagcttctcttatggaaaccaggaaactaattgctgaagcaactcgttcgatccaagctgcagagtcaggacagatttcatatgttggaaacaagaaggacagttctccttttgacttgaatgaagatctagttggagatgaaacaggtgaacaagatggaacagttccttcacctgaccagaaagaagtaaatggtactcatgtctactctgacgcgatatcagactttgagtttggtaactttgatctcgaaggcatgctggatgatgacgaacttctagagatggaaggtctagatgatgatgatgatgatttcgtaccagctcaagtagaagtcaatggttacagtcacaagcttgatccaaaatctgaactagcagttcctgttgaagaaatgcaagaagctatcaagtctcaaatcaccacacaggaagtaccggtgagcaacaaggcagaaaagactagtgtgcgttctaacaacacaacagtcaagaagaaatggatccgtgggagactagttgaagtagaagaagactag

SEQ ID NO: 280 - DNA, 664 bp, Papaver somniferum
tttaaatccagatgttatattgggggtaaaatctgcaagatgataattgatagtggcagtgtggataattatattgctgatcacgtagttaagaagcttgaactaccagtaacttctcatccagaaccttacactgtaggatgggttaatgcctctagcacacagaatattactcttcagtgttatgtgtcattctcttttgagggttatgaagacacagttctatgtgatgtcattaatatgacgacaacccatcttcttcttggcagaccttggcaatacgatcttcacgcggttcacaatggattcgagaatacttacacttttgttcataatgggaaaaccaaggttcttcgtccatccaattccacttcaaactcttgtgcgcagactgatgctgtcgtagccactgttattcgttctttgcacccacaacattctttacattcccatgaagattctaagcctatgattgagttgcctgcaaaggtgaagcccttattatttcaatataatgttttatttccagatgaactaccaactgcattacctcctttacggaatattcaacactgcatcgattttattcctggagcctctttaccaaaccaagcacactatcgcttgagtcctgctgagcatgagatattacagggacaggtaa

SEQ ID NO: 281 - DNA, 2372 bp, Papaver somniferum; identical to SEQ ID NO: 158

SEQ ID NO: 282 - DNA, 453 bp, Papaver somniferum
gctgaacctagttcagcagtagatctggagactaaatcaacagtggcgaaaacagctaaaggaaaaggcaaagcggttgctgttgatgtgacggagaagaggaggaaatcaaaaagtaattctgaggcaaaatctcaaattagaagaccgaggaagagaacagatggtccgttgaagaaattaaagagtgtgataagtaaaggtaagaagaaggttggtgtaaaagaagaagacgatgaagaggttgcagatctagttattgacaaccctgaagaagccgtagatgaggaagaagaaattgaagatgtccttgtggagaaaaagaagaggaagatcaataaatctgagaaacagaaagaggattgccgtttaattggtgaaccggtacctgttgaagaggctagacaaagatggcctcatcgttatgatgcacaaaagataagggaagagatc

SEQ ID NO: 283 - DNA, 1038 bp, Papaver somniferum
atggatattgtgaagtttcttcagccaaagttcactctcatggagaacgtagtagacatcatgagatttttgggtggaacgcttggtcggtatgccatgggaaggcttgtcgcaatgcagtaccaagttcgtcttggtttattgatagctggaagttatgggctaccacagtttcgtatgcgcacctttctttggggtgccaaaatgacagagaaactaccacaattccctcttccgacccataaggttattgctcgtgggtttagccctaaggagtttgagcgaaatgttgtaaaggggaatgaagagtctactctgcagctgaaggatgcattggttcttaaagatgcaatttttgatttgcctgagattacaactcatgaaatccaggatgagagggactatggtaatgatattcatacgacagacttgacagactttcagaagatgattcgcttgccaaagcacaagttgatggggtcagcttacccagaggaatcagggactttaaagctttttgatcacaggcctctgaaactaagcgaagatgataatcttcgggtttctaagatccccagggaaaagggcgcgaacttcagaaacctccctggagtgattgttgatgggaacaaggcatgtcgtgatccaaagatggccaaagtaatgattgaaaaatctaaaaagccactggtacctgagtatgccataaaatttgtcaggggaacttccaaaaagccatttggaagactctggtgggatgaaatcgtgtctaccgttgtcacacgtgctgagccacataaccagataatattgcatcctgaacaagaccgggtgttatcaatcagggagaatgctcgtcttcaaggttttccagatttttatcgtctgtttggtactgtgaagcagaggtacatgcaagttggtaacgccgtggctgtaccggtaggaaaagctctaggattttctcttgcaaaggctgtaaacaatacttctggcagtggacaggtttttgaactccctccatccttctcaaggtga

SEQ ID NO: 284 - DNA, 315 bp, Papaver somniferum
atgagtatgcagtcactgaaagactggccggatacttcagtagcagcggagcctggaatatgtatgccatacacaaatcagtatatacaatttcaaatacacatcttggttcattctcagtttcataaccatttcaaaatcatctcaccaaacccatacttcctgcaacatctcattcattcaggccatcccataacacctacagtttcatctacacaaacaacaccaccattctctagctatcaacaccaccaatatacggttcatgcatctcatacaattctttcactgagaagaacaattacctcaagataa

SEQ ID NO: 285 - DNA, 2013 bp, Papaver somniferum
atgatgaattttggagtaacacaaaaaggaggtggttcagggtttcctgtaattcctaaatcacttgcatcaattgtagtttcagttggtggattagctttgtttgtcatttttgcttcatggcttttgatatctaaccctgctagtactcctgttaatggttcttctttatttagcattagtaataattcaactaaatctggtttcgattcgtcgcctttggtaggtcttgacaataacaatgagactgttactttgcttactcagaaaccaccttcagatagtgttgatgatgagaaattaccctcgattagttctgataagatagattcagatgcaagtggtgagattaaagaaaagggtgttgaaacaggaccaattgataacaaatcacctgatgtttcttctgataagccagaggagatacttcccaaggattctgacaagattgatttaggagaaaaaggaaaacaagagataacttctaacattccagaggagattccagttccatcacctccattatctgatgtaactagtaaaattgattcaggagaaaagggtgttgaagcgggaggcgatgacaagataactgattctgaatttccttcgactacaaaaaaggaaattacagttccttctcctccattgtcgaaggatttaggagaagagggagtaaagcaggagttatcggattctacttctcatacaccagaggaaatttcagttccttcacctccagtatctattttatctaacgaaactgatacaggaaagaagggttttgaaaccgaaactgatacaggaaataagggttttgaaactgaagacaatggcggggtatctggttcagaatcaccttctaaaacggaagaggaaattccaactccttctcctccattatcaaaggactctagcaagaccgcttcaggtgactgtgatctcttccatggaaaatggttttatgatccagaaggccctctttatacaaacaactcatgtccagtcataacacagatgcagaattgccagggaaatggtaggcctgacaaggaatatgaaagttggcgatggaagccatcacagtgcgacctcccacgatttgatggcaaaaaattcttagaattgatgagagggaagacacttgctttcattggcgactcagttgcgcggaaccagatggaatctatgctatgccttctttggcaggtggaagttccaaagaatcgtgggaacaagcatatgcaacgttggtacttcaggtcaacctctgtcatgattgtccgaatatggtcatcttggctcgttggtaggtcagcagagcccgtcgatgttgcccctgcttcagttgtcaaactccacctagattctccagatgaagactttttccaatacctcccaagttttgacgtggttgtcctctcatctggccattggtttgcgaagcaatctgtctacatgctcaataatgaagttgttggtgggcagctatggtggcctgacaaaaggcgcccaatgaaagtcaacaatatagaagcatttggtatctctacagagacaattctcacagctatgtcaacttatcccaactacactggcttaacaatagtccgtgcattttcacctgatcattatgaaggtggggcttggaacacaggtggatcttgcactgggaaggtgaaacctgcaaccgaattggtagaaaacgggtttacaaatataatgcatgagaaacaggtgacgggatttaaacgagcagttgaaaagtcgaaaaatgggtcaaagttgaggttaatggacatcacagaagcttttggttaccgacatgatggccatccaggaccatacaggagtcctgacccaaacaagaaaacaaaacgtggcccaaatggagagccgccgccacaggattgcttgcactggtgcatgccaggtccagttgatacatggaatgagattgttcttgagatcatacgcagagaatttgaggacaatgttacttcccctgcataa

SEQ ID NO: 286 - DNA, 525 bp, Papaver somniferum
atggccatacatacatcacatcttctatttcaactccaccagcagttcatatcttcaaccaacaccacctgttctatggaatgttgccacttccaccacaatcacacaaccaccagtttactcccatttccatactcaaatcactgttcaatatccaaatttcacgaacatcaattacatccatgcttcaacaaatataacagccttaaatcaagtaacaagatattacctcaaaaacaaacacaaaagtcttcttcttcgtctaattacgcatcattagtatcatctcttccatcagcaatccaaacccatgaacctcaaaactctgttttatcaagaaccctaaattcaatcaccatcattggatttcatcctctaaaacttatcttcatctgtaatgtcactccaaatcctcaattcactcattacccaactcgaatcaacctcttagaacatcgatttcacctttcaatagtttccctgaattttaacgaaaccctaactctccaactcaacactgaataa

SEQ ID NO: 287 - DNA, 1257 bp, Papaver somniferum
atgccaatgtacgattacatatacggtacaatggacaagtccagtgacgatctttacgaaacctcgctgaaaaggacggaagaatcaccggatgtcgttcatctaactcatccaacaacaccggattccatctaccatttacggctaggatttgcatccttagcctcaaaaccatatatgagagaagctaacaacaaacactatttcatcatcaaatggattctatggccattgacatttttgtggagcgtattgtttcaaaggatgttgagtcacacatttgtactcgaaagaaacatttttgatgatcaccaagtgaccaagaagctactccaagtacagacatgggcaatacctagatattcttatcaatacaaaaggttgacaaggcaaagaggaacaataaatagtttgattgagaaagccatacttgatgctgataaagctggtgccaaagtgataagcttaggcctcttaaatcagggagaagaaatgaacagaaatggtgaagtttatatacaaaagcatccaaacttgaagattaagattgtggatgggagtagcttagctgcagcaatcgtgcttaacagcatcactaatcttaagacgcagcagcaagtagttgttatgatgagagggagacttacaaagctggcttgttacattgccttggctttgtgccaaagaggaattcaagttgtggttaagttgcagagcaccgatgattttgagaagctcaggtcacggtttttcagcacttcgtcagcatcacaggcgtcgttattggcagcaaataatttgattccctccacaaaatatagtgctcatggaaaccgtcaggtgtggctagtggacgacgaatttagtagcgaggagcatatgagtgcaccaaaagaaaccatcttcattccatattcacagattcctccttggtctaattttaagaagaatccgataggggctgctaatattcttcgcaaggattgtgtttactatagtacaccagccatgatgatcccttcatctctcgagaatgtgcactcttgtgagaactggttgccaagaagggtaatgagtgcatggagagtcgcgggaatgttgcacgcactggaggattgggaaggacatgaatgtgggaattggtttatcaaggagaatgacaacatgatcgataaagtatgggctgctggtttgcgccatggtttccgcccttattatttacctgttccctgcaccagcgctgtcattgctgcttaa

SEQ ID NO: 288 - DNA, 547 bp, Papaver somniferum
atgcatccatggaaggcaccaggaccagacgactttccactaggtttcttccagactcagtggggcactacaaaagaggatgtaatacagatgattcagagcttatttaccagtgggagaatgctaaggaagatgaataagactaatctttgtttgataccaaacatccagttaccacaggcaccaggtgactacatgccaatagatttatgtaacaccacatataagctgatcacaaagattatggcaatgaggctgaaacctttgatgaataagctaatttcaccaatgcaggcatcatatgtcccagggagacaaataggagacaatatcactcttgcacatgaattaatccattggatgaaaagaaagaagacaaaaatgggatacatggaatcgaagttagacatgttcaatgcatttgatcaagtggaatggtctttcttgcccaaagtcatggaaacttttggttttgctgatcatttttgtgacttgatacatgaatgcatcagcactaaaaagattcagattatgctaaatggttcac

SEQ ID NO: 289 - DNA, 336 bp, Papaver somniferum
atggcaatgtcgaagagtagaaaccgttttgtttttgtaaggtattttccgatggcaatgtcaaagagtagaagcctcacacagtgtgcagcaaaaatgtcaaagagtagaaaccgttttgtttttgtaaggtattttccgatggcaatgtcaaagagtagaatcctcacacagtgtgcagcaaaaactattcgacgcaagctgaagtggatacacaagttggtggttacagtcacctttctctttgcaattttaaagtatatttctcatatttggattcgattgttcatggttgaggtacatttctcatatgtgtctgtgtacaagtacaactag

SEQ ID NO: 290 - DNA, 1950 bp, Papaver somniferum
cacactttctttggcaaggctgcacatttagttgacagtactaaccaagttggccatttccagaaggttcttacttccattgggaatttctgcatttgctcgatagcggtgggactgatcattgagatcatcgttatgtttcctatccagcatcgaccgtaccgaaccggaatcaacaaccttcttgttctcttaattggagggatacccatagctatgcccaccgtgttatccgttacgcttgcaattggctctcatcgcctctcacaacagggtgctattacaaaacggatgactgcgatagaagaaatggcaggaatggatgtcctctgcagtgacaaaactggaaccctgacactgaatcgcctcacggtcgaccgaagccttattgaggtttttaacaaaaacatggacaaagacactgttgtgttgcttgcagctagagcctcaagacttgaaaatcaggacgccatcgacacggccattgttaacatgcttgctgatccgaaggaggcacgcgaaaacatcacaccagttcattttctacccttcaatcctgtagaaaagcggactgcaattacatacatcgatgccgagggaaactggcatagggctagtaaaggagctccagaacagattctcaacttatgccaagaaaaagaacagatagctgggaaagtacatgccatcattgacaagtttgctgaaaggggattgcggtctcttggggttgcttgtcaggaagttccagagaaatctgaagctagtccaggaggtccatggacattttgtgggttgttaccattatttgatccacctagacatgacagtgcagagaccattcggagagcacttcaccttggggtttgtgtcaagatgattacaggtgaccagttggcaattgcaaaagagacaggtcggcgtcttggaatggggacaaatatgtatccttcttctgcattgctcgaccgtaacagagatgaccatgaagctcttcctgtggatgaactcgttgaacaagcagatggtttcgctggtgtattccccgaacacaagtatgaaattgtgaaaatgctacaagagaagaagcacatatgtggaatgaccggggacggggtgaacgatgcgcctgctctgaagaaggcagatattggtattgcagtgtcagattctacagatgctgccagaagtgctgctgacatagttctaacagaacctggattaagcgtcattatccatgccgtcctgacaagccgttccattttccaaagaatgaaaaattatacgatttacgcggtttcgataaccataaggattgtgcttggttttgtgcttcttacattgatctggaaatatgatttcccaccattcatggttctggttattgctatactcaacgatggtaccattatgacgatatccaaagaccgtgtgaagccatctcccaaaccggacaactggaaactgaatgagatattcgcaactggcattgtcatagggacttatcttgcattagttaccgtcttattttactggatagtgaccgcgacaactttcattcagacccacttccatttgaggactctaagcttaactaacggggaggtatcatctgcggtatatctacatgtcagcgtcatcagccaagctctaatatttgtgactcgcagtcaaagctggtcgtttgtcgaaaggccaggaattctattgatgtgtgcatttgtggtggcacaattggttgctaccgtaatagcagtctatgcaaatgtcagcttcgcatcaatccatggcattggatggggttgggctggcgcaatatggttctacagcttgctcttagcggcggagcctggaatctgttgtttgatagaaagacggctttcacttctaagaaagattacgggaaggaagatagagaagcaaagtgggttctttctcaaagattactag

SEQ ID NO: 291 - DNA, 399 bp, Papaver somniferum
atgtataacgtcaagaacccaataatcattgatcagaactattgtgatcaagatgatccttgcgatgaacaggaatcggctgttcaaattagcgatgtaatatacaagaacataacaggaactagcgcttcagaagttgctgtatattttgattgcagcaagaattatccatgtcaagacatagttttgcaagatataaatctagtgagagatgaagatggaaaagcagctacatcttcgtgcaagaatgtcaaattgactcaagtcggaaaagtttcgcctggttgtagtagggttcaactcaaagaatggtttcttaagaggatagaagaggaagaagaaaaagaagaagatattttccatggccatgaccaagttgtctattacactgatcattaa

SEQ ID NO: 292 - DNA, 891 bp, Papaver somniferum
atggctccacaaaaaaatgtattctcaaatattctgttttcgatagtattaatcttcattctttgtaacaactcgtactgttgtcgtgggggtgctactcttacttcactagacctacatcccacagatgaacaacctagtgatagtaataatgaacaaggagaaatcctcaggttccgtggcattaacaatggccacataaaggtttcagctaaaaggatgatgagtgttgctgactttggagctaaaggtgacggtaagacagatgattctaaggctttttttaaggcttggaagaaagcttgctcctccaaaaacgctattgagcttgtaatacctaagaagaaaaattattgcctcaaacccgctacatttaaaggtccatgcaaatccaatattacaattaagatagatggagccatcgaagcttctgcagatcgatcagattataaacgggatgtcagacattggattatcttcaagaagattcaaaatctcgtagttgaaggtgatggaacaattgatggaaaaggagatatttggtggaagaattcatgtaaaattaataaatctcgtccctgtacacatgcgccgacggctttaaccttcaaagagtgcaataatctaactgtggaaaacataaccataaaagatgggcagcaaatgcatctaagttttcaaaaatgtatgaaagttgaagctcacaatttactgataactgcaccagaaaaaagcccgaatacagatggtattcatgtcacgcgaactcaaaatatcactattatcaactctgttattggtacaggtgatgactgcatctctatagttaatgggtctcgaaatgtacaagcaactaacactacgtgtggaccaggccatggaataaggtaa

SEQ ID NO: 293 - DNA, 519 bp, Papaver somniferum
atgccccatgtatatcaagctacttcggccaagtgtgcttttagggtgtgctctgatcagaaaagagagttcctctcgaaatttcacagtcctgtcagaagggcacttttggtaattacacaaatcatttctccacttaaaatcagaaattgtaaaaccctaatcagtcctagtccgccttcaattttcagatttccacaatttcagatcttatctcaagttttgcagatcgatccatgcaataaatttccccacaagtttcaattcctatttctcatttttgatcttcccccaaatcaaaaccccaataagtggagtattcattttgttatatgggattttggtggagggatcggaacacacaaagacaaccatagcatgatgatatttcctctcaaaacagagccttatgaattcatggaggccggtataaggatcaaggcattttgctgctgcaggaattcctcaaggaagttatgcttgattgattttattaatcaagtaagtaattgtgaataa

SEQ ID NO: 294 - DNA, 576 bp, Papaver somniferum
atggatctaaaagaacaaaatgatctattgattgatcttgaaagtggtggtagtgaagaagaagcagtaatactaatagttaataataaagaacaacagcaagaacccattgcatcgaaagcaaggaatttgttagataaggcgtggaatggtattataacttcttcaattgatgttatcactggtggtggtggtgaagatggaaagaatgctgtagcaaatggtgatttggagaatggtggagaggtagtagaaaagaggtgtttattacaaggaggaggaggaggagaagatacattgagtccgttactggtggtaaagaaaaaagagaagaaatcgaagaccaaagtatctgctccaaaaccacccagaccacctagaggaccatcactggatgctgctgatcagaaattgattagagaaatctctgagctagccatgttgaagcgggcaagaattgaacgtatgagagcacataagaagatgaaagcatcaaaagctgcatcctctaatagtaatatgtatgccatgatcatcactgttatgttctgcctcgtcataattgtccaagtttga

SEQ ID NO: 295 - DNA, 1779 bp, Papaver somniferum
gaaaaagaaggcaaagaaaaaggtaaggatgtggatgaaagacctgcttacatggatgactttgatgatgattttggtcagtacatgaagggtgagcatgatgtagatcttttccctgaagaagaagtttttactccagtagatcctagcaaaatggaggtaaaaactagatttgcaaataaggaagcatttaagaaacatctcaggggttattgtgttcttaataagtgtcaatatattttggatagaagtgctccctctagaattaaggctgagtgtaggtttaaaacagaacatgattgtccttggtttgtgtatgctagcaagaaagagggtgagaagacttttgttcttaggaaagtgaatttggaacataagtgtgaaggggatccccaaaataggaatagatctgctgatcctcattttgtaaaggattttgttcttgatcagatgaagaataagcctaaaaaagttgttccagacccttataaaatcaaggaagacttcttagctgaaaagagagtaaatataccatatcagtgtgcatggaaggctaggaatctagttttagagtcattatatgggaactataaagaaagttacaatgaagtaccagcattctgcaagatgtttacaaaatgcaatgatgggtctgttgctaagttcacttttgacacagtgaataacacctttgaaagcatgacactctcatttgaacctgcaatgaggggttggcgaaaagcatgcaggggagttatagggcttgatgcctgccatctaacaggggaatatgggggagtattgatggctgcaactgcacttgatggacagaatgggttagtaatgttaggaattatggtatgcagagctgaaacaaaggaaaattggatcatttttttgaagcatttgaaggatgcaatattagcacatccagtgaaagtggctttcatttcagataggcaaaaaggtttattggaagctgttggtatagtgttccctggccatcaccacagatactgttggagacatttatacaaaaatttcaagaaggattacaagggtcttgaattatacagttctttatggaatgcagcaaaagcatacaaagaaaagcattttcaggaacattttgacaatattgtgaaacagagtgctgcagctggtgcttatctcagtagagaagatcctgctacatggtccagggccttttttaaccctattcactgttgtgaacatatgaacaacaatttttcagagtcttttaacaatatgatcaacaagatgagaaataaaccaattataatgataggaataatgtatgctaacttagtgatgggtacatggtacaataggaggactgaatctgcatcatgggtagatggtaatttggttcctactgctgttacattgattaagaaaatgttggaatttgtgactgactatggtgttgacccttgtgtggctggagagttatatatggtgactagtccaaagaattctgtgttcacagtgaacatacttgccaagacttgctcttgtttgcagtggcagttgagggggttcccctgtatgcatgcagtgagtgcattgcatagcataaggccacaatggagaaagtactgcagtgattactattcagtggagaactataaggccacatatgcaccaacttttgcaccactagatgataaaagtgaatgggtccagtgggatctaatccaactgcaaagaggcaaaggactgaatgtgatgcacaaagcttcaccttcagcaacatag

SEQ ID NO: 296 - DNA, 498 bp, Papaver somniferum
atgttgaaagaatttggtttggtggggcttcatgacttgtttgaaattcgtgagaagtggactccagcttacaatcgaggtactttctttgccggcatgaattcaacacaaagaagtgatagtattatttctttctttgatcattctgtgaactccagaatgtgtttgcgagaatttgttgaaagctgtgatcaagcactagaaagaatttacattagagaacgggatgaagattacgagtctatccatgtgaagcgtatatttgtttcccaagatttgttagtgaagcatgcatctgaaatctatacgaggaatttgtttatcaaagtgcacgaacagtttaatgcttcttcacgatatcggtcggaagcaattgaggctgatggtgatgaagaaacttatagagtgtactcgttcaatgatgaagtaccgacggaacagtttctagtaaagattaataaggtaacgaacaaaggtgtatgtggttgccaagaatag

SEQ ID NO: 297 - DNA, 315 bp, Papaver somniferum
atgtatgcaaatagatcttcggttttggataatgatggtttggtaatgaaagatcataagcttggaactgaagccacgaggattagtcattactgtcaacggtcaactaaattagcttatatattgggtaagtctgagaaagcttatgacgtggcaatgggtttccttgatcaagcatttgagaaattgaaggagatagacattgatgagcttagagcagaatatggcaaaaatacccagttggaaaaatatgctaatgatgagcaattagtgacagaaaattcatgtgatgcagctgagctaacacacagatga

SEQ ID NO: 298 - DNA, 423 bp, Papaver somniferum
atggttgggttttcagggtctgctggctggacggctgaaactcatagaatcctttcttggcaattcagttccactttagaaatcaatgaaggaaaaaccaataaggaaaacctttcagatatttatagaggaaatggtagtaaagatgacgaacgaagaagtggtagcaaaattggattggtagtgggtcttgtggttggtttgggtgtttttggttgtgggttctgtttagctttggttttctggtgggctcaaagaactttgatgacgataaagagaattccaatatggacaatgaatttgagaaaggtacgggaccaaagaagttctcatatagcgacctggtttatgcaacgaataactttgatgaaagtagaaaaattggggagggaggatccgggggagtttacaagggatttttaa

SEQ ID NO: 299 - DNA, 460 bp, Papaver somniferum
cttacagattttgatacacacttctcatttatcataggaagtatagaagctaaaggtaatggtgatggtatcactttctttttggctccattcggatcaaaagttcctcctagatcctctgttggatcgcttgctttattcgtttctgagagggctgatgacccgcggaagaatcgagttgttgcagttgagtttgacacatttcagaacgcatgggatccaagtcctgaccacgttggtatcaacgttaactcgattgtatctgtggctaatgtgtcgtggaatagtagtatgaaggatggaagaacagctaatgctcaggtaagttataactcgactacgaaaaatctaagtgtttttctagcttatgatgattatcctgtttttggtgggaaatcaattttgtatcatattgttgatctaagcaaggttctaccccaaaggattatggttgggtttt

SEQ ID NO: 300 - DNA, 1620 bp, Papaver somniferum
atggaagaagagaagatatcactgttgatgaaaaattgggcgatcgatattgatgttttgaatagagattcccagaaggcgcgatggaataagccttctatttacaagttgccggcacctaccacaggtggtagcagtttccaccataacgataacaataagaagtccgctgcttaccttccttacactgtctcctttggtccttaccatcaccacaagggtgaccatctgaagaagatggatccccataagcaccgcgtcctcggtcatttcctaagaagatacaacataaatccccaaaaacttgtcgactcactcaccaccaccagctgcggacggcaacaggtagatcatgttgacgaggccaatactgatccaaaagcgttacctatacttgctgaggaggaggtattacctgtactgcagcatctcatggattcttatgactccctggatgatgagtggctctatgatcgagatgggttcttgaagctcatgatacttgatgggtgtttcatgcttgaaattttacagtggtcgtccgtatatgacaatcacaacgcattatcatctggatcagttacagcagctacatccttggccggctcaattgatgactacttctatgctgacaacgaccctatattcagtcgtcatggcaagttatatgtcatgtctcacataaggagggacatgttgatgctcgaaaaccaactccctatgcttcttcttaagactttgctcggtgccgttctacccactcaacagaaggaggatatcgaagagcatttgaacacgattgcatccaacttctgtagaggcaattcaagttatagaaatcaaaatacgggttcatgtttgcacgtattagacctctacaggaagagtctgttatctattttgccagaagacctacgggaaggctccgcccttaaaaataagaactccggtgatcattactgttggggtcgcagtaaggcgaaaggtcccactattctattttctggtcagacggcgagtgctgatcagaagaatagtactgctggtagcgatggcaccggtgaagatatcataaggtcggcaatgaatcttcatgactctggtatcaagtttgagaaaagtacggataacctgactgacatatggttcgaaggtcacgtactgaaactcccggtgatggtcatcgacgacattacagaatcaacgttactcaacctgatggcattcgagaggttccacgtaggagcagggaacgggatcacgtcatacgtgtgcttcatggacaatatcattgattcctcggacgatgttaaaattttgaggtccgctggggttttgcacaatgcgatagggagtgacaaggcagtggcgaagttgtttaacgagatgaccaaggacgtaacacctgaccctgaaagcaggctagagaaagtagtgcagaagcagttggatgaatactgcaggagccagtggcacgagtggcgtgctaatctttgccacacctacttcaagagcccatgggctcttctctcactcttggctgcagtatttctcttggctctcaccatatgtcagacattctataccatttatccatactacaagcccagtggaaaatag

SEQ ID NO: 301 - DNA, 800 bp, Papaver somniferum
atgactggtaagagacactacttttctgaactcaatgagaaaatcaaaggacaagtgaagtttggggatggatcttctgtagaaattgaagggaaaggatcaattctatttcagagcaagaccggagaacagaagcttgtcacaaacatctacttcatcccaaacttacaaagcaacattctaagtttaggacaggctacagaagttggatgtgatgttaggatgcgacaagattatctaacagttcatgacccaagtggaagacttttagttagagtctcacgctcacagaatagagtctacaagataagtctcatgattggaaggccattgtgtctgaatatgagactggaagatcagacatggaagtggcacgcaaggttaggacacataagtttcagaaccttaaaaactatgtctcagaacaagatggttcgagggctaccacagataaacgatgaatcaaagatctgtgaatcatgtttagttgggaaacaaacgcgtcaaggttttccaaaagcaacaacattcagagtggtagtaagtcacgacgtggtgtttgatgagacaacacattggaactggaaagaaactaatgatggaccaagtagggatccaggaatgtttcacatgagatggggtcaagtaattgatgaaggcgaaggacccataatcatcaataccaatggaaacaatgatgttaatcaagaagaagaagagaataatgaaaccactgagaataacgaagaagaagaagaagaagaagaagaagaagaagaagaagaagaagaagaagaaga

SEQ ID NO: 302 - DNA, 438 bp, Papaver somniferum
atgtctgaatttgaaagagtgaagatgaaagacactgatactattgatagctttgcaggaaagctatcagagatagcctcaaaagctgcgtcacttggacaatccattgatgaagataaactggtaaagaagtttctcaatagtttaccaagatccaagtatattcatatcatagcttctctcgaacaagtcttagatttaaagaagactagctatgaagatataattggaagattgaaagcatatgaagagagaatccttgatgaagaaaacaatggagaaactcaaggaaaactcttgtacacaaactcttaccaacaaaactctgcgacaagaggaagaggtcgtggaagaggtggtagagtaaacaaaggccgaggaaggggaggaaggtttaactcacaagatagaacaacaagtcagaatgatcaaaactaa

SEQ ID NO: 303 - DNA, 1365 bp, Papaver somniferum
ctagttgataagccaggtggggtaaaagtgattggtcttaagtggatcttcaaaataaaacggaatgatgatggtactgtcaacaaatataaggcaagacttgtatctaagggatacgttcaagaattaggcatagactttgatgaagttttcgcaccagttgctagactagagacaattcgtctcttaatagcagaagcaacatcaaactcatgggaaattcaccacttagacgttaagacaacattcttacatggtgaattgcgagaagacgtgtatggtgaacaaccagaaggttttgaagtaaaaggacaagagcataaggtttataagttatcaaaagctctatatggtctaagacaagctcctcgagcctggaatacaaagttagatcaaatcttaagagaaatcggatttgttaagtgctctaaagaaacatcagtatacagaagagaagaaaagggaacacttcttgtgattgcagtctatgtagatgatccatttttgactggaaactcccttaaggtgatcaatgagttcaagagagaaatgtcatcaaagtttgagatgtcagacctcggaaaactcacttattaccttggcatagaagtccatcaaggagtagatgggattcatattaaacaagaagcttatgcaaggagaattctgaaagaagcaggacttgaaacttgtaatccaactaagataccaatggagtttggacttaaagtttcaaaggcacaagaagaagctgagattgatccaacgagttatggaagaaatgttggatgccttagatacttattacacacaagaccagatttggctttctctgtgggagtagcaagccgttatatgcagagtccacgcaagtctcatggtgatgtaataaagcagatattgagatatctaagaggaacaatcagctatggattgaagtatggtaaaggaggatcaaaaggaattgttgggtatagtgacagcagtcataatgttgaccaagatgatggaaaaagtacaactggtcatatattttatctaggagaagcacctattacatggtgttcacagaagcaagacgctgtagccctctcatcctgtgaagctgagtttatggctgcaacagaagcaactaaacaatcaatatggcttcaagaactgatgggtgaaatcaaaggaagagaacctgaaaaagttctcatcaagattgataataagtctgcaattgcactcactaaaaatccagtgtttcatgggaagacgaaacacattcacaaaaggtatcatttcatacgagaatgtatcgagaaggagatcatcaacgttgaacacataccaggaactgagcagaaagcagatatatga

SEQ ID NO: 304 - DNA, 883 bp, Papaver somniferum
atgctactttctgttaatgatgaaccaaggaattttcaggaagcaaaggtctcgactaaatggacacaagcatgtagagaagaaattatttcaatcaacagaaacaagacttggtttctagttgataagccaggtggggtaaaagtgattggcctcaagtggatctttaaggttaaaagaaatgctgatggaactattaacaaatataaggcaagacttgtagctaagggatacgttcaagaatcaggcatagactttgatgaagttttcgcaccagttgctagactagagacaattcgtctcttaatagcagaagctgcatcaaactcttgggaaatacatcatttagacgtaaagacggcattcttgcatggcgaactaagtgaagatgtgtatgttgaacaaccagaaggtttcgaagtaaagggacaagaacatagagtttacaagttgacaaaagctctctatggtctaagacaagcccctcgagcctggaatacaaagttagatcaaatcataaagggaatgagattcataaagtgttctaaagaaagttctgtatacagaagagaagaaaagggaacgcttcttgtgattgcagtctatgtagatgatctatttttaactggcaactcccttaaggtgatcaatgagttcaagagagaaatgtcatcaaagtttgagatgtcagacctcggaaaactcacttattaccttggcatagaaatccatcaaggagtagatgggattcagattaaacaagaagcttatgcaaggagaattctgaaagaagcaggacttgaaacttgtaatccaactaagataccaatggagtttggacttaaagtttcaaaggcacaagaagaagctgagattgatccaa

SEQ ID NO: 305 - DNA, 1350 bp, Papaver somniferum
atggggtttgaggtgattgatagaattggggtagtaaatgaatcaagaactgaagaaatagggtctacaattgtgaaacaagaagtttctgttgaagaacaactaacatctatgagtatacacgggtcaagaaatacaagtccttccagtagagctgggtcgaggaatactagtccgtcgagccgagctggatcgagaaatactagtccttcaaggcaaaaggctgtgaagacaaagcctcgagggttcgatgaggagactgttgcaacatttggtaaatttattcatcctgatatccaaatggaagataatatatgggcgatgttacctgaagatttgttgaatgagattttagctagagtacctccttttatgatttttcggctgcgttctgtgtgtaaaaggtggaattcaatacttcaagataatagtttccttaagttatattctcaattgccttcccatggaccttgtcttctcacattttcaaaaagccctcaaacattgcagtgttcaatattcagcttgccactgaaaacatggtacaaaataccgtttacattcttaccacaatgggcgttttggttagttggttcttcaggaggtcttgtttgtttctcgggatcagatggggttactttcaaaactttggtttgtaacccgcttactcaagcttggaggacacttcctattatgcattataatcagcaaagacagttaattttggttgctgatcggacagataggtctttcaaagtcatagctactagtgatatttatggtgacaagacgttgcccactgaggtttatgattcgaaacttaattcttggtctgttcatcagataatgcctgctgtaaatctttgctcatcgaagatggcgttttgtgactccaggctgtatcttgagaccctttcgccacttgggttgatgatgtataggctggatactggttattgggaacaacttgcagctaaatttccccgttctttgttggatggttatttggttgcagggacacaaaaacgtttgttcctagtggggcgtattggtctttatagcacacttcagagtatgcgaatttgggaattggaccattcaaagattctttgggtagagataagtaggatgccacctaagtatttcagggcattactgaggttatcagcagagagatttgaatgtttcgggcaagataatttgatctgttttacttcttggaatcaaggtaagggtctattatatgacgtcggtaagaaagtgtggtcatggattgctggctgtgctctccagtcttacaacagccaagtatgtttctatgagccaagatttgatgtttccattcattga

SEQ ID NO: 306 - DNA, 1113 bp, Papaver somniferum
atgataccacttttagatttttctcatcagctgtctctgcgtagtttaaaaatcaccatactcgtcacacccaagaaccttccaattctgaacccattactctccgaaaacccttccatcaaaacattagtcttaccctttccgaatcatcctcgtttacctcaaggtgtagaaaacgtcaaggatttatcacccaatcacttctataccatgttgaatgctatgagtggactatacaatcctattcttgaatggttcaaatctcacccttcaccacctgttgcgattatctctgatttctttctgggatggacccatgaactcgcatgcgagcttggtatccctcgtatagatttctctccttctggtgctatggctattgcagtcatggataagctctttcaaaacgtgcccaagctaaatggtgatccttatcatcaaattgaatcatttcctgatattcctagttccccgttttacccctggtggcaactcccttctctctacagaagtcttaaacatggagaaccggaatcggatttcatcagaaagagtatgcttgcgaattttgatagctggggaattgtgatcaactcgttcaatgagttggaatcggtgtatttggattacttgaggaagaaaccgaacgggttgggatattataaccgagtttgggctgtgggtcctattcttccatcggatgatgatgcaactggacccgctaaagagagaggcggctcaggctcagtatcgactgatgatattctctcgtggcttgacacgtgtccggatagttcggtggtctacgtttgttttggtagtcaagttgttctctccaccaagcagatggaaggattagcaaggcggctagaatctagtggggttcggtttttatggtgtgttaaagaacccactacagggcatgtggacggtgagtacagtgttgttccagcaggatttgaagatcgtaccgctggtaagggaatgttgattagagggtgggccccacagttgccgatactgaaacacagatcggttggatcatttatgactcattgcggatggaactcggtaatagaaggactcacttctggtgttgtcatgttaacatag

SEQ ID NO: 307 - DNA, 1194 bp, Papaver somniferum
atggctaggggtcctagaagtagcagcagatctcgtcgttctgcaactcctagcacaaattcagcatctacttggcgtcctttggttgatacacgaagatctccatcaaatgatggtttaggcagtcatggaagtccatatgcaagtaatgggcacatgtctcttccatcgtccgagggtgagcattctcccggtcaggggagtccattatctggcggtgagccatggcctgaggctttacagcagacaaacaccgatagtgaagctgacaatagtgaagaaagcgtaattggtgatcaacgtattccaattgcattcaatgacaacggacaacctataggtcctacccgtaggacattttccaccaaacttggaaagataaccagaaatcttgcttcaccaggttatataacatggaaggatgtcctgctgccagtgaaggaatcgatatggaagagtattactaatgactatatggttcctcaagttctgaaggacaaagtactgaaaagggcacataaggcatggaagaattcaaagactcccctaaggctgatatgtgataaatataccactgttgctgaaatgaaaaacaatagacctggaaatgtgaggaaagaggattgggagaaatttgttgatatggtgaataaagatgaagatagggtcattagggaaaaaatgaagcgagctaggaaagagttgaaagcgttgcatagcattggtagggttggtattgcatctcgccgggaggaaatggaaaaacaaaatcctattgttcagaaaacggtgagggagttgtatgcaatggaagagaacagaaatgagaccccattagataaggatgcagttgcaaagacatttggtgttgatggaaggggtactgttcgaggcatgggaggtggggtttcaaagactgagttacgagcatccgcagttagcagagaacaactacgacaggaaaagctaaagactgtagccgtggaaactcgtgtctgtggtcttgaggagacggttgaggaactaagacagttggctctaaatgcaaaccctagtaccagcaatcctagtaatgctcagcaaatgaatgtgggtggtcgaagaatccagaatattgtgttaaggaatatgcgttggggtgcagttgcatttggtcgtattgataggattgctgatgaaaatgatgctttttaa

SEQ ID NO: 308 - DNA, 378 bp, Papaver somniferum
atgaaagcaaggtatcaatgttctaatgttttctttactgaattattgaaatttatgaaaactattttacccgaagggaacacgttaccagattcttgtcgtaaagctaaggacatgattaagccatttaacttgccggtcgagattatccatgcttgctctaatgattgcatactttatcggaaggagtatgctgattgtgatgagtgtcctaaatgtcacgcaagtagatggcaactacctcctgaagggagtaatccaaatgctaaaaaggtgccagtgaagaaactaagatatttcccaattactgaaaggctgcagcgttggtatggtactccgtggatagctgaacagatgtactggcattcaaatgtttag

SEQ ID NO: 309 - DNA, 441 bp, Papaver somniferum
atgcgacatcctgtggattcttcttcttggaaatcaatagataggaaatggcctgcgtttgcttccgagaaacgtaatgtgcgtctaggactagtcactgatggttttaatccattcggaatgatgacttcgcacaatacttggcctgtcatgattaatgcttataaccttccaccatcaatatgcacagggaaagatttcacaatgttagtattacttattcctggtccaagtgctcccaaccacaacattgatgtctatttgcagccgttgatcgaggagttgattgagttatggttaagcggaaagctaacatatgatgctcatacaaagacttgtttcacaatgaaagcaattttaatgtggtgcatacacgactatccggcttatgcacacatgtctggtttgcgaacatctggaaaatttggttgtctggcatga

SEQ ID NO: 310 - DNA, 357 bp, Papaver somniferum
atgtacccttttgagaggtttactcctttaactactgatccttttaatttaattcttttgaacttatgtacattatatatctggtgttaccttttgaacaaaaactatattggagggtctattactgcacagcatgatgtcgttgaaggagctcgccattggatggagttcattcccgagggtaagctaaagtcttacaagtgtcatggaaaggtagcattgcgcggtgaggtatatgaaggtccacacccgcctacttcacgtggaaaaccataccagttaactgccgtacaacatgagcaagttcaactttgggttttgagacattcagatgaaaatattgaatgggaagagtaa

SEQ ID NO: 311 - DNA, 330 bp, Papaver somniferum
atgacatcggaaaacaacaaaaagctcggaggaagaaaaatgttggtgaccgctgataacgatagaaagaccgcgataaaacacgaaaatgcaggacaatttattggagaggctactactaagatttcaggtgctgaacattcttctgttggaaacactgataagtctcaaaaagggaataatgaagggggtgagctgaatgtagaatctaacaaattcatgagtaacactgatagaagtagtctgccagtgaacgttagtctaggtgattctatagctgtgagtgctgattatcttgacccaagacctcacccacctaaaaataactga

SEQ ID NO: 312 - DNA, 435 bp, Papaver somniferum
atgacagcaccaaccgagtcagtccagtgtttcaggcgtaagaagacagcagtagctgtaactcactgcaagaaaggtcgtggtttaatcaagatcaatggaagtccaatcgagttggttgaaccagagattcttcgattcaaagcttatgaaccgattctcatattaggtcgtcagagatttgctggtgttgatatgagaattagggttcgtggtggtggtcatacttcacagatttatgctattcgtcagagtattgctaaagcattagttgcttattatcagaagtatgttgatgaacaacaaaagaaagagatcaaagatatacttgtcaggtatgatcgtactctccttgttgctgatccaagacgctgtgaacctaagaagtttggtggtcgtggtgctcgttccaggtttcagaagtcttaccgttga

SEQ ID NO: 313 - DNA, 1089 bp, Papaver somniferum
atgaatgcctatgaccttctgaacttcatattcaccattgtcttctggaggacgcatttgcgcctcttcttcagtttcttcattctgttcgtgctcaattggtactccaggtttgggaaaatcagttcccaacaaaaggtattctccacaaagccggtaccattctttcaacaattgcaagaagtcctcagctttcatgtttctcacctgtgtttcagggtgattgaactgaagactctcacaggcatctttactgcccatatcgtaaccaggctcacatatgatgcagctgcgcccatgcattggccagtggacatccccccacagccggcatacatatcaagaagcgtcataacctcagaaccacacgctaaggaacgcgtcttggatgatgatgaagcagcttccttgaccacttctgagctaccttcaccagaaatcatagatgatgatgaagcagcggcatcctgtccattttctatgcgcaagttttcgaatgtgcaaaactcatctgagtatgacatcataaaagaaatcacattcagggacatttgtggacgcttgagcaactgtcactttttgaacaataaaattcagtggattggcatctttagagtccgaagaaaatacacgttcacgtttcggttcaattttaccagaatgctctttaattactattctgccaatataatcaagctggccttcttccgcctctcttattgccgtcacctcaacatgggcattaggatcagtatgcttcaaaaccatgttgtggcatctcaaaactactttattattgcgaacaacgactgcaccgaaagggcctccatctccattatccactcctttgtatgcttcttcaactgcttttgttacgaattcatggtccttgtcttgtacagcttcttggtaaccagaaaatgcagtggcaacagatatagttccatccttggcttcgacaactttagcttcttccatggtgggattgagaaattggaatgggattcagtgatcagacagatttcggagagaaatagctattcagaattcagaacaatgttaaactggaagaatctggattctagatag

SEQ ID NO: 314 - DNA, 537 bp, Papaver somniferum
atgcttagtgagcttgaccttgccacaaagaatcgtccctgtaccttcactccagatatgtttcgttgttctcagcagatactggagggtgtggatctgaaacatatgctggagtttgccggccacaaggaagaagtattgtcgacgagacgagctaaaaagattatggaagaggttcagattccggaattaagcgaccacatagatgttcgcaacccagagctcgttatggagcagttcaagggttacgaggaaaaagtaaaaaacgcctcaagtgagattggtgacaatttaaatgtttaccttggctccctgccagtattgaaagctgttaagcgtgtattgttacgactagagcgtatatgtttattgaagtctgtaaattctaagcgtatgtgtttatggaatcctgatgatgacatcaagttactcgagaaaagccatgatgctgctcagaaagcgatgaaagcaggacaaagtggcaaaacatccaacagatttaaggaggtgaactctgctaccttgcttattctttaa

SEQ ID NO: 315 - DNA, 328 bp, Papaver somniferum
atgtcagttgaagaagaccatgacgatgtcatgagtgaagaggatatcacagtagtagagtcgatgacaagtcaagagcatgcttcaaagaaaaggaaatttacatcaaaagtatggaatgattttgattggtcacgagacaaagatggtaaagaaaaggctacgtgcaagcattgtaggaaggaatatgcttatgacagtcagaaaggaggaacatcaactatgtcaaggtatttaaagaagttccctagactgaagatgcaagatgtggggcaacttttgttatctacaaataatggagaacaggctactcgtgcacgcaaaatag

SEQ ID NO: 316 - DNA, 906 bp, Papaver somniferum
atgaattttggaactaaccaaggtgtaaatggcggtttcagtattacacgagaaacatcaaagtgtattcctgtggcaaatggacctattcatcactggaaacattcaaattggtctaatgttgacaattatgggaattttatgactccaagcagcaaggatctcagcctacttcccaatagggtaactcctacttcatctatttctatatcgccaaattttgcagaaccaatacaaaacatgtgcccccaatcctcaacattttgtaccagcttacacgtatcaccatcggcaaccttaaaccctcagatgcagtttcttcaacctggtagcttatcgtcaaccgagtatatgatgcctcaaactgctcagaccatgttacctgttcaactgcaaggtgaaaatttagtagcttatcagcggtacgagggccagcagattatgaatggtggacacactgaattgcttggagatgttattggagctggcaccttcgattgggccactggccgtacctttgatgttgccaggactgacaacattatatctcaacaaaaggggttgcaattacaatcgaaacgcgttgactttatcatgaaccatgacaatcagaatgctcagatggatgaaatttttacagcaactgaacattcccaaattcatggtaatcacagccaggcgaatagaagttttacattttcccttgaagatgagacaaattcttccatctctagcattgatgctctccacaagcctcgaatgcgctggacgcagaagctacacgactgctttgttcaagcaattaatgatttaggtggagctgataaagcaactccaaaaagtgtacagatgaaaatgggtgtcgaaggattaaccatataccatgtgaaaagccacttgcagaaa

SEQ ID NO: 317 - DNA, 807 bp, Papaver somniferum
atggcctttttagatggtaatcctcccgagagactttgcaagccggtcgtggatcatatagagtcacttggcggtgaagtccgtctcaattccaggattaaaaagattgagcttaaaaaagatggtaccgtgaaacgtctaatgctcaccaacggtgatgcaatagaaggagatgcttatgtcattgcaaccccagtggacatcctaaagctgcttatacccgaggagtggaaagaagttgggtactttaaaagattggataaattagttggagttcctgtgattaacgtccatatatggtttgacaagaaattgaaaaatacatatgatcatcttctcttcagcagaagtcccctcttaagcgtatacgctgacatgtcagtgacatgcaaggaatattatgacccaaacaaatccatgcttgagttggtatttgcacccgctgaggaatggatctcgcgcagtgactctgaaattattgaagctactatgcaggagcttgcgaaactctttcctgacgaaattgccgcagaccagagcaaagcaaaaatattgaaataccacattgttaaaacaccaaggtctgtttataaaaccattcctgattgtgagccggcacgtccattacaaagatctcccatagagggtttctatttggctggggactacacgaagcaaaagtatttggcatcaatggaaggtgcagttttatctggaaagctctgtgcgcaagctattgtgaaggattgtgagatgcttgctgctcgggtagaagaaaaaactacagcagaagcaactgttgcttaa

SEQ ID NO: 318 - DNA, 945 bp, Papaver somniferum
atgagtgaccaaaccgtatccgtttcttcgctagatgacaacactcaacaccactctctctgtgatttcaattcaatctcttcttcttcttcctgcttctcctccttcccctttcagttaaatttagagttgaggtcaataataatttcttacctaattttgattttgattttgactccaattctccctctgaacgacaacaacgagaagaagaagaagatgacgagcactactgctagtacagtttcttcggttatcaacaggatttggaattctaactcttctaattcaacatcaacaaccagaggcggtactaatcatctactatttgggggatttcgagggagtattgctactagtagtagctctatgctgctgcctcggtctttaaaatctcatcaaacacctactgctaggacgaccaacaagaagaagaacaattctcctcgaagacctaatttacaggttgtgtgtatggattatccaagacctgaactcgacaacactgttaattacttggaagctgcttatttttcatcttccttcactgtttctccaagacctaataagcctttgattgttgtcattgctggtgcaggcttggctggtttgtcaactgcaaaatacctggcagatgcagggcacaaacccatactcctggaagcaagagatgttctcggtggaaaggtagctgcttggaaggatgatgatggagactggtatgaaaccggactacacatattttttggagcttacccaaacgtgcagaatttgtttggagaacttggtattagtgatcgactgcagtggaaggaacattctatgatttttgcaatgcctagcaagccaggggaattcagccgattcgatttccctgacgttcttcctgcacccttaaatggaatctgggcaatcttaagaaacaatgaaatgcttacatggcct

SEQ ID NO: 319 - DNA, 1542 bp, Papaver somniferum
atggcagcaggaacaacaaccaccagacatcaacaccttgttatttcatcttcattctactgcacgtttctcctcctccttatcacccaaggctccacggttgaggggtttggctgtaactgggggacgcgcgcaacacatccactgccagctgacattgtcgttaagctattgcaagacaatggattcgacaaggtgaagctcttcgaacccgatcctcacgctttaacagctcttgcaacttctgggattcaagttatgttggggatacctaatgaattcctagcagcgcttgcttctagtgttcgagtcgccgaaaactgggtgcagcagaatgtgtccgcttacatcagagacggcgtcgatatacggtatgtagctgtggggaatgaaccatttttgaagacatatggacaagcttacctacagacgacattcccagctctaaagaacattcaagctgcactcatcaaagccgggttaggcaagcaaatcaaagtcaccgtcccgctcaacgccgacgtctaccaaacggataccgatttgccttccggtggtgattttcggccagatatacattccctcatgatctccatcgtcaaattcttaagcgagagcagttaccctcttaccattaacatctatcctttccttagtctatacgccgattcgcacttcccggtcgattacgctttcttctctgggactgctacacctgttgtggacggacctatttcttactcaaatgtctttgaagcgaattacgatactctcatttgggctctcgagaagaatggattcccgtcggttccggtgattatcggggaagttggttggccgaccgatggtgatcccaatgcaaatgtcgagtacgctcgccggtttaaccaaggccttttcaaccgcatttttcaaggccaaggtacgccgaaaaggaagagcgcgccggagacatacgtattcggactgattgacgaagatgcaaagagcatagacccagggaattttgagagacactgggggatgttcaactatgacgggactttgaaatactcgttacagttgggtaataatagaaagctagtcccggcaaagggggtcaagtatttggaaaaacaatggtgtgtaatgtcgccacaagcaagcacttccgatcccatcttcgtagagagcgtgacatacgcctgcactcacgctgattgtaccagccttagttacgggtcgtcttgtggtgatttggacgcagccagcaatgcttcgtatgcatttaacaggttttaccagactgcaaatcaacagagagggagttgtaatttcaacaacttagctgttgtcaccaccacaaatcctaatactcaagatcctaaatgcaagtttgatataatgatcgatgtgagcaagcaagctaaattgtctcctccaaagagccgttcacggtctgcatcttctcctggtcttgtgcaacaaaactccttgtcgtcttggatgattagtaccgtgtttgtaaccctagttttgattgttagtagtagtttggtgtaa

SEQ ID NO: 320 - DNA, 1815 bp, Papaver somniferum
atgtttcctatccagcatcgaccgtaccgaaccggaatcaacaaccttcttgttctcttaattggagggatacccatagctatgcccaccgtgttatccgttacgcttgcaattggctctcatcgcctctcacaacagggtgctattacaaaacggatgactgcgatagaagaaatggcaggaatggatgtcctctgcagtgacaaaactggaaccctgacactgaatcgcctcacggtcgaccgaagccttattgaggtttttaacaaaaacatggacaaagacactgttgtgttgcttgcagctagagcctcaagacttgaaaatcaggacgccatcgacacggccattgttaacatgcttgctgatccgaaggaggcacgcgaaaacatcacaccagttcattttctacccttcaatcctgtagaaaagcggactgcaattacatacatcgatgccgagggaaactggcatagggctagtaaaggagctccagaacagattctcaacttatgccaagaaaaagaacagatagctgggaaagtacatgccatcattgacaagtttgctgaaaggggattgcggtctcttggggttgcttgtcaggaagttccagagaaatctgaagctagtccaggaggtccatggacattttgtgggttgttaccattatttgatccacctagacatgacagtgcagagaccattcggagagcacttcaccttggggtttgtgtcaagatgattacaggtgaccagttggcaattgcaaaagagacaggtcggcgtcttggaatggggacaaatatgtatccttcttctgcattgctcgaccgtaacagagatgaccatgaagctcttcctgtggatgaactcgttgaacaagcagatggtttcgctggtgtattccccgaacacaagtatgaaattgtgaaaatgctacaagagaagaagcacatatgtggaatgaccggggacggggtgaacgatgcgcctgctctgaagaaggcagatattggtattgcagtgtcagattctacagatgctgccagaagtgctgctgacatagttctaacagaacctggattaagcgtcattatccatgccgtcctgacaagccgttccattttccaaagaatgaaaaattatacgatttacgcggtttcgataaccataaggattgtgcttggttttgtgcttcttacattgatctggaaatatgatttcccaccattcatggttctggttattgctatactcaacgatggtaccattatgacgatatccaaagaccgtgtgaagccatctcccaaaccggacaactggaaactgaatgagatattcgcaactggcattgtcatagggacttatcttgcattagttaccgtcttattttactggatagtgaccgcgacaactttcattcagacccacttccatttgaggactctaagcttaactaacggggaggtatcatctgcggtatatctacatgtcagcgtcatcagccaagctctaatatttgtgactcgcagtcaaagctggtcgtttgtcgaaaggccaggaattctattgatgtgtgcatttgtggtggcacaattggttgctaccgtaatagcagtctatgcaaatgtcagcttcgcatcaatccatggcattggatggggttgggctggcgcaatatggttctacagcttgctcttagcggcggagcctggaatctgttgtttgatagaaagacggctttcacttctaagaaagattacgggaaggaagatagagaagcaaagtgggttctttctcaaagattactag

SEQ ID NO: 321 - DNA, 1821 bp, Papaver somniferum
atggcaataaccaatgatgtcggagaagaagaaatagagatgatgatgaaatacttgattgttcgtccggagaaaggcggcatattcaatatgtctagatacttgctcagatacgatgctgctaatcatgatttcattgagaccagtaacaatcattattctaatgatggatatggtgatgagttggtaacagtgagtcgaggaatatcatcagtatctgatggtggcggcggacaagatgatcatagactagtgataatagtatcaatcatagtgaggaaaatcataggggttttaggtaaaccaatggaatggatgggttatctggtggagttcttactcaatcttctgtctctcaatggcggatctatcttctctttgctcaccgtacttctcaacgggaaagtagtgcggccacagaggaattccgaaacatttataagtgccattgggcatttggatggaagaattgatttatacaacaagcagatgccttcatctactcatgatgatccgttattatctagtactgatgctaatggtaatggagagatgattgtgaatgataaaaaaaccagcaacatctttgacttgggagatgaccgatgccttatggatctttgcatgatggcttccaagttagcttatgaaaatgccaaagtcgttcggaatattgttgttcatcattggaagatgcattttgtggaattcttcaacggttggaacgatttccagaaagagaaatctacccaagttttcatcctttgtgataagcccgtagatgccaacttaatattgataagcttcagaggtaccgaaccatttgatgcggatgactggagcactgatttcgactattcctggtatgatatcccaaaattgggtaaagtccacatgggtttcttggaggccttgggtttgggcaacagagatcaagttaccaccttccataatcaccttcaagccgtaggaggaagagatgggtacaattcaaagaccagttttcctgatgaggatgcgaaatcagatgccacgagaaagaagagattgctcccggaaatggctgagttgactgcatattacgcagtaaggactaggctcaaggaactgataaatgaacacaagaatgcaaaattcttagtgactggtcatagcttaggtggtgcgcttgctatactgttcccatcggtgttagtgttgcatgaagagatggagatgatgaataggctattgtgtgtctacacattcggacaaccaaggattggtgatagacagttgggaagatacatggaacctcatctcaactatccaactccgcgatacttcagggtggtttactgcaatgatcttgtgccgaggttgccttacgataacaacaccttcttgttcaagcattttggaccgtgcttgtactataatagcttgtacattgaaacggaattggaagaagaacctaatccgaacttctacgggatcaaatttctgattccagagtatctgaatgcagcttgggagttagcgaggagcttaacaatgggatacactcatggacctgagtacaaggagggttggttttgcatcttgctaaggcttatgggattagcactccctggcatttcagctcactgccccacagactacgttaagtctgtcaggctcgggagaatgtcatcatcctcgtattcttctccatctagatatccctccagaagatcaaaatatgtgtctgctataattctaaatgaagaattaaacttgcagtgtccttacttcagatctggaacgtggttgtcaagctttacaggatccagttctagatga

SEQ ID NO: 322 - DNA, 609 bp, Papaver somniferum
atgtgtgtgtcatcgaatgtttggcatggtagacttggtcatgtaaattacaaatcaatgcataaactggctagcgtaggctgcatactcaaattcactttagataaaagtcataagtgtgagatttgcgtagaatctaagcatgctaagaaatcattcaggaagaatgtccagagaaacactaaacccttagaattgattcattcagacgtagttgacatgaagtcagttcaaactagaggtggtaagaaatggtttgtcacttttatagatgattgtacgaggtactgtcaggattatttgcttagagggaaggacgatgccttagaagcctttaagatatataaacgtgaagttgaaaaccaattgaatgctaccattaaaacgtttaggtctgaccgtggtggtgagtatctaattcctattggagatttctgtgaagaacatggcataatacatgaaactacagccccttattcacctcaatccaatggtgtagctgaacgaaagaaccgtacccttaaggatatgatgaatgccatgttgattagttcaggattacctgcggacttgtggggggaggcagtcctcttaactagtatttcctga

SEQ ID NO: 323 - DNA, 938 bp, Papaver somniferum
gagcatttgaaatatatcagggacatggcatctaaaccaggcatcctcactgaatggccatgggcaactcttggaaggttcaagtacattttgttggctccttttgtgttggatagcctgtctccattgttcttcgaatcagataccaggaaatgggacttgagttactccctcacgtttccatttctcttgtggagagtgattcacaaccagatatggataagcttttctcgttttagaacttccaaatccaaaaacaggatactcgacaaatctatcgagtttgaacaagtcgacagagaaagcaactgggatgataatatcatattgcaaggactgatgttttatctgggacaaaaatatctggagggcggttcacaccttcccttgtggagaactgatggtgttgtcatgactattctacttcataccggtcctgtcgagttcctctactattggcttcacagatctttgcatcaccattttctctactctcgctaccattcccaccatcactcttccattgctactgaacccattacttctgtgatacatccatttggggagcaccttatgtatttcgcactgtttatgataccattgttaaatatggttttcaccgggactgggtcgatagtagctttcgctgcgtatatcacttatattgattttatgaacaacatgggccactgcaatttcgaatttataccgtcttctctcttcacaacatttccattcctcaagtgcattttctacactgcatcgtatcattcacttcatcacacccaattcagaacaaattatgcattgttcatgccaatgtacgattacatatacggtacagtggacaagtccagtgacgaactttacgaaacctcgctgaaaagggcggaagaatcaccggacgtcgttcacctaactcatccaactacaccgga

SEQ ID NO: 324 - DNA, 1221 bp, Papaver somniferum
atgccaatgtacgattacatatacggtacaatggacaagtccagtgacgatctttacgaaacctcgctgaaaaggacggaagaatcaccggatgtcgttcatctaactcatccaacaacaccggattccatctaccatttacggctaggatttgcatccttagcctcaaaaccatatatgagagaagctaacaacaaacactatttcatcatcaaatggattctatggccattgacatttttgtggagcgtattgtttcaaaggatgttgagtcacacatttgtactcgaaagaaacatttttgatgatcaccaagtgaccaagaagctactccaagtacagacatgggcaatacctagatattcttatcaatacaaaaggttgacaaggcaaagaggaacaataaatagtttgattgagaaagccatacttgatgctgataaagctggtgccaaagtgataagcttaggcctcttaaatcagggagaagaaatgaacagaaatggtgaagtttatatacaaaagcatccaaacttgaagattaagattgtggatgggagtagcttagctgcagcaatcgtgcttaacagcatcactaatcttaagacgcagcagcaagtagttgttatgatgagagggagacttacaaagctggcttgttacattgccttggctttgtgccaaagaggaattcaagttgtggttaagttgcagagcaccgatgattttgagaagctcaggtcacggtttttcagcacttcgtcagcatcacaggcgtcgttattggcagcaaataatttgattccctccacaaaatatagtgctcatggaaaccgtcaggtgtggctagtggacgacgaatttagtagcgaggagcatatgagtgcaccaaaagaaaccatcttcattccatattcacagattcctccttggtctaattttaagaagaatccgaaaggggcagctaatattcttcgcaaggattgtgtttactatagtacaccagccatgatgatcccttcatctctcgagaatgtgcactcttgtgagaactggttgccaagaagggtaatgagtgcatggcatgtagcgggagttgtgcatgcattggaaggatgggattcacatgagtgcggagacaagttactcgatgtggagaaagtatggagtgctgctgttcgtcatggattccgacttcctattgtggttcacagttcttaa

SEQ ID NO: 325 - DNA, 411 bp, Papaver somniferum
atgacagtggtgaatgtgtgcgcgttttgtaatgttagtgaggagtcagtagagcatttgtttcttcattgctcttttgttgggcagatttgggaacaatttttacatcagctgggtattggttgggttcatcctacgacagttatggaattcctttggaagtggaaattgaagttttctactaaacctctcattttcttgaggtattgtttaccttttgcgatatggtggtcggtgtggttagaaaggaacgacatcttaatagcgcagaaacaaggaagaaaaaccttaacttctcttattatagatatcaagtcgttgatttttagttggactgttaatgttgagtcgtttaagcagatcaaatttgatgattttgttttcgattgggtgaatttgtttagagagtag

SEQ ID NO: 326 - DNA, 798 bp, Papaver somniferum; identical to SEQ ID NO: 54

SEQ ID NO: 327 - DNA, 957 bp, Papaver somniferum
atgtcaagtgtacaagaacaagagttaccagaaccagaccattacaacgatgttatgagtggtgacggtcaagatgatgatgatgatgttgagatgctagattctgtgaatgaggatccaactgttggttgtgcacctgcacaagttgcacgtggaaagaaaaatagacttagatccgaagtttgggaattttttaaactcgttaagtataaggatggtacaacgaagggggtgtgcaaggcttgtaatgtaggatataaatatgaaagccaaagaggtggaacctcagccatgaaaaggcataagtgcattaaacgtcagtctatggacgtagggcagatgatattagcttcacaaaacagccagatgtctacccgtgtacgcaaggttgatcaaatgaaattacgggatttgttctcagctttactcattgcaagaaatgttccatttgctttggtggagtggaaagagtttagggatatatgtgcttatttaaatgatgactttaaaccaatatcaaggaatactgggaaagccgatgtggtaaagaaacataaagcacaaaaagaagttattcgcaacagattgaaacttgctccaggtaggatatgtctaacatcagacatgtggacttctgtaacaactactggatatataagcttaactgcgcactatcttgataaagattgggtattgcaaaagaagcttctgaatttctctccccttccaccacctcatacaggtgaacacctttcttctaagttatttgcaatgatagaagattggggaattgaagaaaaggtatccaacatcaccttggataatgctgcaaataacggagcttgtgctggaattatgaagagtagacttgttgcaaagaagatcctgttgaacgatggaaaatactttcatgtgcgttgttgtgctcatatcttagctcttattgtaaaagaatga

SEQ ID NO: 328 - DNA, 2169 bp, Papaver somniferum
atgctcaacctcaagatggaggtgctgctgctcttctgtgtcgccttctcctgcatttttcaatctaatcttctgctcatcaatggggatacagatcaaaaggatgctgctgctcttggggttatgtacaccagcttgaactcaccacaacagctaacaggatggattgcaaatggtggagacccttgtggaattgggatcaattggaaaggtgttacctgcaccggcacatccgttacagcactaaaattatcaggtcttcaactgaatggaaatgtgggatacaatttgcaagatttgagttcattgaaggaactggatttgagcaacaataatcttggaggcagtataccatacagtcttcctccaaaccttgaaagactaaatcttgccaaaaatactttcaatggagctattccctattccatttctctaatggcatctcttaaatacctagacctcagtcataatcaactgcaaaaccaattgggcgacttattcaacaaccttcctgaacttatcacattggatgtctcttttaatgccctaaatagcaacctttctcagagtcttagcgcactgccaagtgtgaagaacatatatctgcaaaataaccaattcacgggtacacttgatgtccttgcaaatcttcccctggaaaatctgaatgtggagaataaccaatttattggttgggttcctgcccagttaaaaggcataaagagcctcaagaccggtggtaatcaatggttctcagggcctgcaccgccagcaccacctgggccacctcgacgcgccaagccaaaaccgaaatctgatgacaatggcaaggacaaatctgattctaacggagatgggaagaaatcaggccttggagctggaggtatagctggaataattgtagcacttttggttgttgggttagcagtggcattcattttgataaagaagaagaaatccaaaaagtcatctacagatattgaaaagcacgaagaagatcatcacttcactcctctcgcttcaaatgaagttaaagaaatgaagtctatgcaggccccctcagaacctgccaaaaagacatttgaaactacttctgcagcagtgaaccttcgacctccacctattgaacgactcaaatcatttgatgaagaagactattcaacaaaacctgttgtggtaaagaaagcgaatgccgctcccattagtgccacagtttactccatagcggatctgcagatggctacagctagcttcagtgtagataacctcatcggagagggttctattggacgtgtttatcaagctcaatttgatgacgggaaggttcttgctgtgaagaaaattgattcatctgctctgccaaaccaatcatcacgagatttcttggagatagtatcagacatctctcggttgcatcatccaaatgtgacagagcttgtgggatactgttctgagcacggacaacacctcctaatctacgatttttacaaaaatggttcacttcatgatttcttgcacctctcagatgaatactctaaaccattgtcatggagttcccgcgtcacaattgctctaggaactgcacgagcactagagtatttgcacgaggtttgctcaccatctattgttcataagaatttcaagtccggcaacatcctgctggattcggaactcacccctcacctctcagattgcggaatggcaagctttgtccaaaatgcagatcatcagggattagacataaacacaggttctggatatagtgcaccagaagttgcaatgtccggccaatataccttaaagagtgatgtctacagttttggagtcgtcatgttggagcttctcactggtcgtaaaccctttgacagctcaagatcaagatccgaacaatctttggttcggtgggcaacacctcagctccatgacattgatgcattagataaaatggttgactcgtcactgaaaggacactaccctcctaaatccctctcacgattcgctgacgtggttgctctctgtgtccagtctgagccagagttccgaccaccaatgtcagaggttgtacaggcgctagtacgactagtgcaacgagctaacatgagcaaaagaaatctcggagaagatcgacgatcagaagacccagatgttgtgcaggatgacatgtattag

SEQ ID NO: 329 - DNA, 1281 bp, Papaver somniferum
atggctccagaaccagaggatgatatcatgaacgagaagaacccacctcctttggatgaagacgatattgcccttctaaagacctatggattgggtccatactcaaatagtattaaaaagactgagaaggagattaaagagatggccaagaaggtcaatgatttatgcgggattaaggagtctgacactggattagctgccccgagtcagtgggatcttgtttctgataagcaaatgatgcaggaagagcagcctcttcaggttgctagatgtacaaagattattaatgcaaacactgaagatgccaagtatgtcattaatgtcaagcagattgcaaagtttgttgttggcttgggggacaaagtctcacctactgacattgaagaaggaatgcgtgttggtgttgacagaaataaatatcagattcaaatccccctacccccaaagattgatccaagtgttactatgatgactgtcgaagaaaagcccgatgtaacctatgctgatgttggtggatgtaaagagcaaattgagaagatgcgagaggttgttgaactgcccatgcttcatcctgaaaaattcgtcaagcttggaattgatcctcctaagggtgttctctgctatggaccacctggtactggcaaaacactactagctagagctgtagccaacagaactgatgcatgtttcatcagagttattggaagtgagcttgtccagaaatacgttggtgagggagctcgtatggttcgagagcttttccagatggcccgttcaaagaaggcttgcattgtgtttttcgatgaagttgatgcaattggtggtgctcgttttgatgacggtgttggtggggataatgaggtgcaacgtactatgcttgagattgtgaatcagcttgatggattcgatgcacgtggaaacattaaagtgctcatggcgaccaacaggcctgacactttggacccagctctattgcgtcctggacggttagatcgtaaagttgaatttgggttgcctgacttggaaagcaggacccagatattcaaaattcatactaggacaatgaactgtgaacgtgacattaggtttgagctcttagcccgtctttgcccaaattccactggagctgatatccgtagtgtgtgtaccgaggctggaatgtatgcaatccgtgcacgtaggaaaaccgtgacagagaaagacttccttgatgctgtcaacaaggtcatcaagggttaccaaaagttcagtgcaactcccaagtacatggtgtacaactga

SEQ ID NO: 330 - DNA, 1296 bp, Papaver somniferum
atggctgaacaagaattagaaatggagttagaagattattcactgaagaaggagaagaagaagaagagaaagaggaaacaacccattgatttgaaaatagagatggtgaaagaaaatcaagaaaagatagctccattagtaggttattttccaactggttatgaccctcataagaaggctcaagatgatggtaatggtgatgatgttaaggtttacagacatgttagacgttctcgtttagagcttgttgttaaacctaaaggatccaaggttaattttgttggtactaattattctggggaagctgaagctcctatatcctgtcagtatgctcttggtgttttcgataaggagacgcaaactctaaaaatcgtcaaaattgaatccaataagatttttagactggaaccgaagttcgcaggcaaagataaagcacctgacgaagcaaaggttgaagcattaaccgcacaagagagggcagagagattgaatgatcttaccatggccctcggaacaaagaaggctaaaaagcaggtcagagagaaggctaacctgaacagaaaggaaaatgaagagacccaaaaacagatgggagaaaaaattaagaagcttaaggtcctggcaaatgccacggcaggtgataattcagaacctgctcgtaacatcccgtaccatgatactactgctgaaacgccagaaagagcttatcctatagagaaaattatttctaaaggggaaaatgaaatcctccaaaaagctctacactatctgttctacacggaaaaagtagcactcgaagcttttccaatttttgtccgcaatcggatacagaaaatgaaggaaatcgaggatgaaacggagagacagactcttggtgtcatattgtcgtatatgacgcacctcatcaagtttaaggataaacattcagtagaccatcaagcatctgcaaaagaccaccgaattccagagatgttactccaaagcttcaaaagcaagttcaaagatgcagatgatggtggaaagaagaaacgcgaaatgtctggtccaaagaatgatctcctgataagccacgtgttagtactcagtctcatggtggacgatttcaactctaacccaactgatatcgcccaggacttgaggatgacgacgctaaaactgagaccacattacttgaacttgggtgtcaagatggttggtggaaatgggaaaggaaagatcgcacaagctacacttcctgttcctcttaacttccccccaatggagcaacgcagaaggaaaaagggtcgtaaatattaa

SEQ ID NO: 331 - DNA, 819 bp, Papaver somniferum; identical to SEQ ID NO: 277

SEQ ID NO: 332 - DNA, 1374 bp, Papaver somniferum; identical to SEQ ID NO: 87

SEQ ID NO: 333 - DNA, 1746 bp, Papaver somniferum; identical to SEQ ID NO: 89

SEQ ID NO: 334 - DNA, 951 bp, Papaver somniferum
atgagtatggaaaggattgtaggtgcaaagtataagttaggaagaaagatcggcagtggatcctttggtgaaatctaccttgcaacacagattgatacaaatgagatctttgctgttaagattgaaaacacaaagacaaagcacccacagcttctatatgaagcaaaattgtataatattcttcaaggagggagtggtattgcggggataaaatggtttggggttgatggggaagagaatgttttggtcattgatttgttgggaccgagtttagaagatctttttgtatactgtggaaggaaattttctttaaaaacagtcttaatgttggctgatcaaatgattacaagaattgagtatatgcactctaaaggatttttgcatcgggacatcaaaccagataacttcctcatgggtcttggtcggaaagcaaatcaagtctatatcattgattttggacttgctaaaagatatcgggagtctaccactaaccgccacattccttatagagagaacaaaagtttaacagggactgctcgatatgcgagttgcaatactcaccttggcattgaacaaagtcggcgagatgatttggagtctcttggttatgtgcttttatactttttaagaggaagtcttccctggcagggtttaaaagctgctacaaagaagcaaaaatatgacaagatatgtgagaagaagctatccactcctattgaagttttgtgcaagtcccatccggtggagtttgcctcgtacttccattactgccattctttgacatttgatcaacgaccagattatggtttcttaaaacgcctattccgtgatttgtttactcgtgaaggacatcagttcgattacatatttgactggactatcctaaagtaccagcaagcacaaaagacaaaagttcagccacgggggcctgttagtattccgattttctaa

SEQ ID NO: 335 - DNA, 1062 bp, Papaver somniferum
atgaaaaagcaaaccaaagcaatttctatgtctagattaattggatttgatcagatttcaacaaaatcgggtcaaatctcatttgaagatgttaagattctcacttctaatggacttaaaatctttgctaactcaattatattgggctcaagttctaaagtattggagaaaatcttagatcgaccaagtaaacatcagaattctgtgaaggtaattccaattcttggagttccttgtgatgctgtaaccgctttcatacaatttctttattcatcaagatgcacagaagaagaaattgatggatatggaattcatctactagctttgtcacatgttttctctgtacaacaactgaaacagagatgtacaaaaggattgtcaacaagattaatggtagaaaacgttgttgatgttcttcaacttgctagattatgtgatgcacctgatctgtatttgaaatgtatgagattcttatcgaaggaattcaaagctgttaagagaactgaagggtggaaattcttaagagccaatgatgctgttcttgaactcgaaatcttacaatacctcgacgagatcgaatcgagagataaaaagaggagtagaagtaaagaagaacggggtatatatctagagctaagcgaagcgatggaatgtcttgaacatatttgtacagaaggttgtacaaacgtcggaccatatgatagagagccaactaagaaaactggaccatgtgaaaaattctcaacttgccaaggtctacaaggtttaattaaacactttgcaatgtgtacgaagagaatgaatggtggatgttgcaggtgtaagaggatggggcagcttctaaaacttcatgcttcaatttgtgatcaagatgatcattgttgcaaagtccctttgtgtagacaattcaagttgaagaatcaactagaaaggaaagcagatgacggaagatggagattactagtaaaaaaagtggtttgcgcaaaaactgtatcttccttgtcttcaccaaaattgatgatcttgagaaggaaagaagaagaagacaggcaacaaaggtga

SEQ ID NO: 336 - DNA, 337 bp, Papaver somniferum
atgttaacgaattggtccactacagaaacgagacttcataagttctgggatttgagagcggaacaaaagaagggaagactcaaccgccttccaaaacgagatgcagcaatgttgaagagacaattatatcacttgcaaacatatctgggtgggatcaaatatatgacggggttacccgatattgtaatcatcgttgatcagcaagaagaatatacggctcttcgagaatgtgtaactttgggaattccaacgatttgtttaatcgatacaaattgtgacccggatctcgcagatatttcgattccagccaatgatgacgctatagcttcaatccgat

SEQ ID NO: 337 - DNA, 444 bp, Papaver somniferum
atgttcctatttatttttgtttctaactggtcaggggctcttttaccttggaaaataatacagttacctcatggggagttagccgcacctacgaatgatataaatactaccgttgctttagctttactcacgtccgtggcatatttctatgcgggtcttaccaaaaaaggattgggttatttcggtaaatacattcaaccaactccaatccttttaccaattaacatcctagaagatttcacaaaacccttatcactaagttttcggcttttcgggaatatattggctgatgaattagtagttgttgttcttgtttctttagtacctttagtggttcctatacctgtcatgttccttggattatttacaagcgggattcaagctcttatttttgcaactttagccgcggcgtatataggcgaatccatggaaggtcatcattaa

SEQ ID NO: 338 - DNA, 327 bp, Papaver somniferum
atgaatttaatgaactgtaagagtccagacattacctatattgtgagtaagttaagtatatatacttgtagtccagaacaagagcattgggatgcgcttaatagagtattatggtacctaaaatactgtattaccttttgttttatttatgaaaggtatcttgttgtccttgagggactttgtgatgcaaactggatagttgactcagaggagtctaagtctacgagtggatatgttttcactctagcaagagggtttgtttctggaagtttttcagacaaacatatattgctcaattcattatggaatctgagagtattgcgttag

SEQ ID NO: 339 - DNA, 843 bp, Papaver somniferum
atggttcttgccatggaacaatggtcttcgagtctggaacgacgacacgacgaacccgaattcaacttgagagaatgggcactgaaggcaagaaatattagtagaacaaataccagttccagaagattttcagctccaaatattacaagttttagagaactggaaacaaaatcgtttagatcaaacactacgataactagcactgcttcttctcctggccacaccttaacagatgaaattgacccatccacttattctttcacaagtgctctaaaagctttacaggcaaaaacaggatacggatgggaatggttatcacctgaggggatttctttaagttccaaatggaatgaagcggagaaatatatttgcaatccgttttctggtgaatttccagcggaatgcttgtcagcaaaaacactaaggagaaggtccatgtcaagttcaacaagcaaatttacaatgtcagcacctcttgattactcttttcgtcctccactttctcggtcgaaatctaacaggacacaagaccataaagaaattgattctcaatctacaattcaagaggagaaggcagaaagttttaagaaggatttggaaagtattattccaactaatcataactcaagcaactccaacggcgcatcttcacccgctccttcgtcgacaaatcctccagtcgaagaaaaaagactgataatgcaagatgaagttgaaggcagagaagaacccaccatctcgaccatagaaccaaagtttgatgatgaccagttcaacagtcatggatgcgtctgcaaatgggtcattttgtacctaacaaagctgcaatatgaagctggatag

SEQ ID NO: 340 - DNA, 636 bp, Papaver somniferum
atgaagcttaaacagttagaatcttatctgggtaatcttgaccagttctcaaatccaaagattgaactggaacagtacccgacaggatctcatattgcatctcgaatgttatacactgcagagaattcatttggggatataagtgggaaagtagttgcagattttggttgtgggtgtggtactctaagtattgcaagtgctcttttgggtgctgaatatgttctcggaattgatgttgataccgattcccttgaaattgcgggagaaaacgcagaggatcttgaggtggacataaattttgttcagtgtgacatcaacaatctgaatttgagaggtaaaattgttgacactgttgtaatgaatcctccatttggtacaaggaaaaagggtgcagacatgaatttcctcgccgtggctatgaaggttgcatcacaagctgtttattccttgcataagacaacgaccagagatcatataaagaagacagcattacgggatctaaatgctaaaagtgccgaggtcatatgtgagcttcgatatgatgtgccacagctttacaaatttcataagaagaaagaggttgatattgcagtagacctatggagatttgttcctcagagagatcaagaaaggtaa

SEQ ID NO: 341 - DNA, 309 bp, Papaver somniferum
aaaacacaaaagtttcttaggcaatttagaggaaaacttaaagattctttagtaatagaagttctacagctattgaagcatcgtccggaagtgggagttaagttcttcatttgggccgccagacaaattgggtatacccacacgccagccacctatgctgctttgttggtcactttaggggttgaagataatgatagtagtaacaataagaacaattatgttagagttcctgaacatctccttttagagattagagatgatggtgacaaagtaatcctgggaaagttactgaattttttgattcagaaa

SEQ ID NO: 342 - DNA, 390 bp, Papaver somniferum
atggtgacttataatgctatacttcaggtccttctcaaggccgaccggttggatgctgcttgtctgcttcacagggaaatgtcaaattccggtattggtgtggatggtttgacgttgggtagcttcgctcgatctctgtgtaagtttgggcggtggcaagaagctctaggaatcattgaaaaggaagactacatatacgatgcagtaatttacacgaaaatgatcagtgggttatgtgaagcttcactttttgaagaagctatggagtttttgcataggatgaggtctaacaattgtgtaccgaacgtaataacttataggacgttgcttgatgggtgtttgaggaaaagacagctaggtaggtgtaaaagaatccttagtatgatgatt

SEQ ID NO: 343 - DNA, 1251 bp, Papaver somniferum
atgctgtcagctggttgtgttccgaatgttgtcacatacacagttttgattgatggacactgtaaggctggtgatgtcaagaaggcttgtcagatttattcaagaatgggaggaaatggagatatgccagatgttagtcagtactttagggttgatggaaataatccaacagaacctaatgtttttacatatggagcattagtggacggtttgtgcaaagcccataaagtgtctgaggctcgtgacttgttcgaaactatgtcaggagaaggatgtgagccgaataatgttgttcatgatgctcttattgatgggctctgcaaggctggaaaattagatgaagcgcaagaggtttttgcaaagatgtcagaatgtgggcacagtccaagtgtttacacatacagctctttgattgatagactgttcaaagacaagagggttgacttagctatgaaggtcttatccaagatgttagaaaattcttgctcccctactgtggttacatatacagaaatggtggacggactttgtaaggtaggaaagaccgaggaagcgtataaacttttcgtattgatggaaaataaggggtgccgtccaaatgttgtgacttacactgcaatgatagatggatttgggaaagtgggtgatatcaacatgtgccttaaacttttcagacagatgagtgcaaagggctgtgctccaaattttataacatacagggtcttgatagaccattgttgtgcggcaggacatctggatgagggtcatgaacttctacaggagatgaagcagacttgctggccagcacatgtgacaggttatcgtaaggtgattgaaggttttaatagagagtttatttgctcactaggtcttttagacgtgatggtagcagatggttccttgccgatagttcctgcttacaggattttggttcacagcttttgcaaggctggaaggctggacgtagctctggagttgtataaagaactcgtaacagtttcagatggcttagggcttagccataatttgtatgcttctctgataaagagtctttctctagctttcaaggttgatgaagcttttggtttgtatgtagacatgacaaggatgggttatattccagatataagtgttatttttaatctcattaaaggccttacgaaagttaacaagtgggatgaggcgcttcaactttcagatagtatatgtcagatggacatcaattatattcctggggtggaagaaacatag

SEQ ID NO: 344 - DNA, 720 bp, Papaver somniferum
atgacttttccaaaattggaaattgttggcgagcacaagattgatactgtggtgtgtggttttggttatcattcctctattcagaactacaaaattgtaagaatctactatatccagaaccagccattgggacgggtccaggtatatacacttggaggtggtagcagtggttggagagacttgggagaaaccgtttactcactgcgacacagtaaattctgtttgcggggtgatcgctccccgtttggtgtgcttgcaaatggagctcttcattggctagacactgaacaaaagattgtgtcctttgatttggtagcagagaacttatatttgctcccatcaccaccttttgtctctgatactagtgtgacgaattgttttcaacttcaggtactgggaggatgcttgtgttttgttcatctaaagccagataaattcttagacatatggttgttaaggaagaaaggtgagagtagcagttctgacgtgaacgtgcaggattacgactcattgacctggatcaaggagttcagtataccaataatgggtgatgctgcagagccattttcccttacagaagtggtgaagtgctactgtggtacaagtctactatctgttatgataaaaaaactgcagccttcaataagcttttgggtggcactcttttggatggcacttgttatcgtgcagttcctcatacaagcagctttctttcgctga

SEQ ID NO: 345 - DNA, 222 bp, Papaver somniferum
atgaagatagagattgagggagcaagtattgatcctcctgtattccctgcagtcaacactgctatatttgcaaatccagttggctttcctcaacgtggactacgaaggggtggagctatgggacgactcagaggtggcacgggtagtggaggtcgcattccccagagggggggaggtcgaggcagggataagtaccacacagaagcgatgcaaataaactaa

SEQ ID NO: 346 - DNA, 1770 bp, Papaver somniferum
atgagtctgcaacaagctggacagcccaggcctactgcgaatgggactggtcgtcgaagaggggaacaggagacagggtttcggtcaggaagtaattttcctaccgaaaagccaaatcatggaatggccattgttggaggtatactgaatcgaagcagagaaggaggagttcaaggtccttcacgtgatcgattgatatatttggcagcgtgtcttatcggacatcgcgtggaggtccaagtgaaaaatggatctatattttctgggatacttcatgcaatgaatgccgaaaatgattttggaattgtcctgaaaatggctaatttaacgaaggttggtttgtccaaaggacataagcctggttctgattctattagcaaggcaccttcaaagactttgatagtacctgctaaagaacttgtgcaagtcattgcaaaggatgtgtcggtaactggcagtgaagtgaaaaatgatggacaacttgaaggacgtcaggaccttatgatagactcctacatatctaagtctcaatttgttgatgtggggagagagctggcaccctgggcacctgatgaagatgatttgcagtgtcctgaattggacaacatatttgatggcccctggaatagtaggaaatgggatcagtttgaaactaatgaggcattatttggagttaagagtaccttcgacgaggaactgtacacaacaaaacttgacagaggccctcaaatgagagagcgagaaagagaagcttccagaatagctagagagattgagggggaggatactaaagatatgcatttagctgaggaaagaggtcgtcactttgatcttgatgtggatgaggagaccagattctcatcagtcttgaggacagtggatgatagtggatacgatgatgatgaggatattgtattagatactcacaatatggagacctttggtgattcttcaggtgcagcatctaaaagatccttttctgatgtggctagagggaagacagacaatcttggtccatcaccgagctcttcgtcagtggcggatgaagcacattctcgcttcaacgctggtcgggaccaatacttctctgcttctggtgatcgtccaagacaaattgattgtgagagcactcagagcagggtgaatgagaacaaattcaaagaattagatggtaggaagaacagcgtaaaagagtcagtggagagaaaatctgtaaatgaggttcaagcaccaaaccttgaggggtcaagaagatctcaggttacaacacagcatgtccatccccgaggacgttcagggagttcagcgtcctctactgcggaatctgcacaaagtggggcttccccgactatggctcgttctggtttgtcacctagctcatccatggggtcattgtcttctgagaagtcagcattaaatcctaacgcaaaggaatttaaatttaatcctaatgcaaagagtttcaccccgtcagtatcaccagtacgacctccttctccggtacctgatggttcctattattatccaaataatgtttctccggtccaacatatgcacggattaccagttggtgttgggatgggggcagcatatgggggaccgcagcctgttatgtacactccacaagttgcacctatacaaccagctcagacatttttgcaccctaatggacaactgtatggacagcagatgattgttggccaccctaggcaagtattgtacatgccaaactatcctccggacatgccatacaagggaagagatttctaa

SEQ ID NO: 347 - DNA, 204 bp, Papaver somniferum
atgggagtcttcacatttgtttgcaagagttcaggtggaaaatggagtgcaaagcagttcgaaggtgatgttgaagcatcagccgactgtgcttatgatttggagaggaaattggttcaggaagctctttctcgtgattcttctggtgctgttcaatccaacttctctttgattactcctacttctggtgtcttccaggtttga

SEQ ID NO: 348 - DNA, 1425 bp, Papaver somniferum; identical to SEQ ID NO: 230

SEQ ID NO: 349 - DNA, 525 bp, Papaver somniferum
atgaggtaccttgacctgtctcgttgtaatttttatggaggacatgatgtgtccatcaatcaactttacaatttgcagacactagtgcttcatagatgccatgatgttaaaacgattctgctaggcattggctctctgaagacattaaggcaccttgatctttcgtattcggatgttgaaacactacctgattgtgttgttcagcttgctaattttcagacattagatctaaatatgtgcaagagattggtagccttacctgtaaatattgggtctttggaagctctaagagtgttgaaagtaaaaaactgtataactttaagagtcttacatacagatgtgggaacattgacacgatttaggtgcctggatttgtcagttactaagatcaaagtattacccaagtcctgcatcaacaaccttcggaatttggagttaatggtatttggaaagtgtaggattcccaaagagattaaaaattggccaaaattgagacttcttaaacataaaagagaaagaagatga

SEQ ID NO: 350 - DNA, 357 bp, Papaver somniferum
atgattgcgactgtaacttctgatgctgagaacaagcaagtcaacagcgcttctgttcgactttggttaagatggctcagagatgttgcgtatgatgctgatgacgttttggatgagttctcttatgaggctatgcgtcgatccgaaatccaccggaaaagagatcaggtactagaattcttttcatcctccagcgctctttccttccctattaagatggttaataaaattaaggctattaacaaaaaactagatgaaattactagtaccatggtcaagtttgagttgcaaacatctgatcctgatgatgatctaagaagtactgagaaacaagaccggaaacatttcactttgtag

SEQ ID NO: 351 - DNA, 717 bp, Papaver somniferum
atggaaactctgaaagaatgggttgttccaatttacaatacatttccttcccttgagaagctagaaatcttcaactgtccaaaactgagaagcatacctaattcatttcctttccttaagaaattgtatttaatggataataacagcgaggcagtcgctgcaattttagctaccggaggacttacctccgtcacctttattgaaataagagaatctcctcagttactatatattccactgagcttactatcccaaaacaatactccaaatcttcaagaactagttattcatgaatgctccgagtttcttggttttgttggagatgattatatattcgaggtctacaacaacagcgagaagaatggtgatgacgataatggatatgatgatctcgaagcattagtattctttctatctaaaatgaacttagactccaactccggcaatatcagcaactctctattgtcattacagttgattgattgtcccaatttatgggtactcccagatatatggtcattcaattctctccggaaattaactatcttcaagtgcgacgaattgaaggagttaataacaaactatctcgaagaatcttttatctttcttgaagagttgaaagttgattttattcaaaaagaattcattcaagaagatccaactgattctcggaagttagttaatttgatggaatttgtggatcagtggaagaagtag

SEQ ID NO: 352 - DNA, 2388 bp, Papaver somniferum
atgtttgattcaagctacagtttatcaagctggagcgttgggttccagttaggcacaccatgtttttgggaagaagtcagcatattagtccaactaggggttctaggaagcattttgatctgcttcatgaagaaaaggtgtgcacatggatcacgaagtatagaggaaggtgtaggaaaataccccagcagcatcagacttggctttgtctacaaatctgcgttagtttgttctgttttaatagcaggaactcatatcttgatgctttggatgattttaaatggatacgacgccctctgcaaatcgaaaaactcagttctctgtaaagaaattctgttagagataacatgcctaatcacattacttctggttttgaatcttcgtcactcaaggtccttgaagctaacaagggttctaagagtctggtggatcttaagcttcatattatctattgtccatacaactctttatacaagttatattcacacaaaccatagatccctaaccatagtgtattacgtcaacttcgtcagcttaatttcctcaacatacttggtaggaatttcaattaacggggcaactggcattagcttcatcaccaatagcaccacagagtcactactgaacaaacttgaaaatcattctgatggaaagaaggaaaaggaatcaccttatcaaagagctacacttctccaactcatcactttctcttggcttagtccattattcaaagttgggtacaagaaaccactcgaacaagaagatgtcccaggcatccacatcaaggactctgctgaattcctctcccattcatttaacaacattctaaaacaagtcaaggagacaaaaaacaccaggagtccatcaatttacatggctatctttctgttcatcaggaaaaaagcagcaattaacgcatttttcgcagtaatcaatgctggagcatcatatgttggtccatacttgatcaatgactttgtggcctttttaactcagaagaaacactacagcttaaagactggttatattattgtactagcattcataagtgccaaaacggttgaagtgattgcagataggcaatgggttttcggggctcgccaactaggcatgaatctgaaaggagtccttataacccacatatataagaagggtcttcatctgtcaagtcagtccaggcaaagccacactagcggagagattattaatctaatgagtgtagatattcagagaattacggaattcatctggtacatgaatataatcgggatgctgccgatccaaatttcactagccacctgtatcctatatttgaatttgggtcttagctcatatgcaggattagccgcaacattaatggtgatgttatgcactatacctcttcaaagaatccagaaacggttgcagtcaaggatcatggaagcgaaggacgaaagaatgaaggctacatcagaaattcttcgaaacatgaagactctcaaacttcaagcatgggacatgaaatatatcctaaagcttgaaaacttgagaaaaatcgagtacagctggttatggaagtcattacatttatcagcactctggggttttatcttcatgacatcccccacatttatctctgcagtgacctttggatcatgcatcttactggggattccactaacagctgggaaagtcttatctgcattggcaaccttcagaatgttacaagattcaatgttcactttaccagattcgctctctgttattgcacaagctaaagtttcagtagataggattgaagcttacctccaagaagatgaaatacaagatgatgcagtcatttttgttccaaaaacatcagaagtggaaatcgagattgaaaatgggattttcaattgggatgtaaaatcacattccccaaccctcagccgaatacaactaaaagttaagagagggatgaaagttgcaatttgtgggactgttgggtcagggaagtctagtttactctcttgcatacttggagagataccaaagatttcgggagaagtgaaaattagtgggacaaaggcatatgttcctcagtccccgtggatatttactggaagtgtaagagataacattctctttgggaatccttatgataaagtcagatacgagagaacaataagagcatgtgcactgacgaaggatttagagctcttccaagctggagacctgacagagataggagaaagagggattaatatgagtggaggtcagaaacaaaggatacaacttgcacgagctgcataccaggatgctgacacatatattctcgatgacccatttagcgctgtagatgctcatacaggaagtcaactttttgaggttatattttcttcctatatgatccaatctaaacgtgaatag

SEQ ID NO: 353 - DNA, 1101 bp, Papaver somniferum
atggaaatgaacctcagactcatagataaccaatcacgaccatggttccacaacgaagcagccatagaatggctctcctttagactgaacatattgtcaaatctggtgtttgcattctcattagtgatactcgtaagcctccctgaagggattctcaacccaagtattgcagggctagctgtgacatatggactgcatctgaatatacttcaagcatgtgttatatggcacttatgcaatgcacagaataaaatgatctcagtagaaagaattttacagtattcgaaacttactagtgaagcccctttggtgattgaagaatgtagacctccaagcaactggcctgagtttggagaaatttgcttcaaaaacctggaggttcgttatgctgaacatcttccgtctatcctcaaaaacataaactgcaagattccgggaagaaagaaagttggtgttgtaggaaggacaggaagcggcaaatccactctcatacaggctctctttaggacagtagaacctagagatggatgcattttaattgatgacattaatatttgcaacattggtctacatgacttgagatccagactcagcatcatacctcaagacccaacaatgtttgagggaacagtcagagcaaacctcgatccactagcacaattctccgacaaagaaatatgggaggctctgcataaatgtcaattaggtgatcttgtacgcaataaggaagggaagttggattcaacagtggcggacaatggagagaattggagcgtaggtcagaggcagttattctgtcttgggagggcattattgaagaaaagcagcattcttgttctagatgaagcaaccgcatctattgattcagctacagatgaaattatacagaaggtcatcagccaggagtttgaaaatcgtacagttgtcagtatagctcacagaatccatacaatcatagacagtgatcttgttctcgtccttagtgaaggaaggatagccgaatacgacatgccagctagactactggaacacgaggattcattcttctcaaagcttataaaggagtactcaatgagatcaaaaggttcatcaacagcttag

SEQ ID NO: 354 - DNA, 684 bp, Papaver somniferum
atgagtttcctcttcgggaaaagaaagactcctgcagagcttctgcgggagaataagaggatgttggataaatctattagagaaattgagagggagagacaagggttacaggcgcaagagaagaaacttattgtggagattaagaaaagcgctaagcaagggcagatgggagctgtgaaagttatggcgaaagatctaatcagaacaagacaccaagtcgaaaagttctataaactcaaatcacagcttcaaggggtatctctcagaattcagacattgaaatcaacccaagcaatgggagaggccatgaaaggtgtaaccaaggcaatgggacagatgaataggcagatgaatttgccatcattgcagaagataatgatggagtttgagaggcaaaatgagaagatggaaatgacaagtgaggtaatggctgatgctattgatgatgctttggagggagatgaggaagagcaggaaactgaggatcttgtgaaccaggtcctcgatgagattggaattgacatcaattcagagctcatgaacgcgcctgcaacagcggtagctgcaccagccgcaactaccaaagtagctcaagctgaacaacctgcagcagcaggaggtaatgacgatggtggtatagatatggatcttcaagcaaggttggacaacttaaggagaatgtaa

SEQ ID NO: 355 - DNA, 897 bp, Papaver somniferum
atggcttcttcttcttcagcatctaagtctgaccagcctcaaatagctaagttcaagattgctctatgtcaaatcagtgtttcattggataagaacaccaatatcgatcgtgctcgtacaatgatcaaagatgcagcaaaaataggtgcaaagcttattgttttgcctgaaatgtggaattgcccctatgcaaatgagaatttccctatatatgctgaagattttgacaatagagagttgtcgccatcattcatgatgttgtcggaagttgcatgtagcgaaggagttacggtagttggtgggtcgataacagaacgatgtggtgatcagttgtataatacttgttgtgtatttggaagcaccggagatttgattgctaaacataggaagattcatctctttgatctgacaggagatgtttgcttcaaagaatctgaaacctttgcagccggaaatcgacctaccattgttgatacagatgttggtcgtattggaataggaatctgccatgatctacgcttccccgaacttgcaatgttgtacagagaaagaggtgctgatctaatatgctatcccggggcgttcaacatgagtaccggtaacttgttttgggagcttgtacaaagagcaagggctgttgacaatcagttgtttgtggccacttgctctccagctcgagactctagtggtagctacatgatttggggacattctactcttgttggaccatttggtgaggtgattgcaacttcagaacacgaggaaacaactatcatcgctgaaatagattattctgtgtgtcaacttcgaagagaaaatcttccacttgagaaacaaaagcggggagacatctaccagtttgtagactgcaccaaagaactgaactcccagcaatga

SEQ ID NO: 356 - DNA, 363 bp, Papaver somniferum
atgagcacaaatgtaattcaagaacataaaaacttgatgacaacaaaatacttcgtcatcccttgccattacaataccgaatcaactatctctttctgtctaaaaataagcaaaacagaaatccaactcaaacaaacccatgctagattactcaaaaccttaatccattcaagccatcagcttcatcatcttctaacacagctactaaagttaccttccaaaaagttgagttatgcacgtaacttgttcgatcaaatacctcagagaggatgcatgagatgggtgttttggcaagtgggtttacgttttcgtctgtgcttaatgcttgtgcgaggataccggctgttcgtgaaggtaaaatga

SEQ ID NO: 357 - DNA, 1308 bp, Papaver somniferum
atggtacaagaagagcacgatgttgctgatggcggagaagtacaagaagggacttctgctgcagtaggagttactcctatagttccacaagaagtacgaagatcatcaagaactccaaaaccaaacccaaggtatgctctgaattatctattacttacggatggagttgaacctgaagatattaaagaagcactagcggctgatgattcaggcaagtggcaacttgctatggaagatgagataaattcacttgaggaggatggcacttgggtgttagtaaaattaccaagaggtaagaaggcgttgcataacaagtgggtttatcggatgaagtctgaagcaaatggagatattcgctataaggagaggttggttgtcaaaggtttccaacaaaaacctagtgttgattacaacgagatattttctccagttgtgaagatgactactattcgagtagtgttaagtctagtggcttctgaagatctctaccttgaacagttggatgtaaagacaacgtttcttcacggtaacctagatgaagaaatttacatgaagcatccagaaggattcatagtaaaaggcaaggaagagatggtgtgcaagctaaagaagagtttgtatggtttaaaacaagcccggagacagtggtacaagaagtttgataacttcatgcatagaggtggttactcacggtgtaatgcagatcattgttgttacttcaaaaggtgcagttctgactacatcatattattactgtatgtggatgatatgttggtttccggaacatctctacaagaagttgagaatttgaagaaacaattatcaagtgagtttgctgtgaaagatcttggtgaagcaaagcagattcttggtatgaggatcataagagacatagctaacggtgtacttatgcttagtcaggctgattatattgaacgagtgttgaaaaggttcaatatggagaatgctaaaccagttagttctccaattggaagtcaaattcttgtttcaagtatgcagtgtgcgaagacaaatgaagaaaaggagtacatggctaacgtaccatattcttcggcgattgggagtctaatgtatgctatggtgtgcatgagaccggatattgcacatgcagtgggagtagtgagtagatatgcaagcaacccaggaaaacaacattgggaagctgtgaagtggattctcaggtatttgagaggtaacacaaacgtatcattgtgttatggaaaaggtggttctatcttgaggggttatgtggatgcagacttcaaaggagatgtagataaaaggtga

SEQ ID NO: 358 - DNA, 798 bp, Papaver somniferum
atgggaagtagcagtatagatgtgaaaccagctgaaacacaagaagttagcatcaaagatcaagctcaattatggaatatgatctacggttttgctgattctcttgttgttcgttgcgcagtagagcttggcattccagatattatcaaaaacaataacgggccaatcacacttgcacaactttcatcaaaactcccaattccgaatgtcaactcggatcacttgtacagaattgtaagatatttaataaacctgaatatcttacaacaagaaatttgtcgtaatgttaaggtctactcacttaaaccagttggtactttacttttaagagatgcagaaagaagtatggtgccaatattattaggcaatacacagaaagatttcttggttccatggcatttcgtgaaagaaggtttagtaaatggaagtacaacagcatttgagaaaggaatgggtatggatatatggaagtatttagaaggtaatccagatcaaagtcagttgtttaacgaaggaatggctggagaaacaagtcttttaactaaaactctaatcgaagattgtagagatactttccaaaatttggattctctagtcgatattggtggaggaaatggtacaacaattaaggcaatctatgaagcttttcctcatatcaaatgtacactttatgatcttcctcatgttgttgccaactctcatgatctccctaacatcgaaaaagttcccggtgatatgttcaagtctgttcccagtgctcaggctatcttactcaaggtgagacttcttctaagttga

SEQ ID NO: 359 - DNA, 1635 bp, Papaver somniferum
atggagttattcataaagttaccatttatccaaccaattcctttcagtattattcttgttactacagtttcgattgttctattatacagtgtcttcttctgggttactgataagaaaaagaagaggaagaaagcaccaaatgctgcaggggcatggccgttaataggtcatctccgtctattgatgaacgacaaggaaccgttgtatagagcactagggagcatggctgataagtacggacctgcattcaacgttcgattaggtagccaacatatcctagttctgagtaattcggatatggtaaaagaatgttttggtgttcaaaatcatgataagttattttcgaatcgtacaacttcattaagtgtgaaatacatatttaacgaggcaacttcaatcgggtttacaccatttggaacatattggagagaaatgcgaaagataacagcgcagcagttactctctaaacaatgtttagaatcatggagacatttgagaatcaaagaaatagatgcctcattcagtagacttaacgacttatgctgcaacaacggtactggaacaactactccaatcagaatggacaattggattgctgatctgacgtataacgtgttcgcaagtgttgtcttcgggtaccaaagtggaggaagggcggcagtaacaggtgatacggcctccatctccgagaaatacaagaacactatgatagaagcttttgttgttcttacgacaagctttgcagtttcagacgtattcccatgtctagagtgggtagatagattaagaggtattgtaagagacctgaaacgcgctagagatgcgttaaattctattgcagggtgtcttattgaagagcaccgccaaaagagatcactagcatcattatccaaacatgatagtactgataaaggagttggtgatccacaagacttcattgatattctcttgtcgattgctgaacaatcacagcttcctggagatgaccctgatttggttatcaagactatgattctggaaaccgtatcaggtgggctcgataccacgacatcaaccttaacttggaccctctctctgttagtaaaccaccctcaagtgttaaagaaggcaatagaggaaatagatatgcacgtcggcctcgatagagatgtacaagagtcggatattcctaagctcgtttacattaatgcaattatcaaagaaacgatgcgattgtatccggtttttccattgattgatcggttcacgttggaagagtgtgaagtcggtggattccatgtgccggctggggggcgcttaatcctgaacgtttggaagatccaaagagatccgagcgtttgggagaatcctctggagttcaaaccagagagatttttgagtaatgatgatgataataaggtggatatggatttcaaagctcaaaaatatgaactcttcccatttgggataggtcggaggatatgtcctggcatgctttcgtcattgcaggtaatgcatcttgtgctggcccgtcttattcactgctttgatatgaaagcagcaagtgccaatgggaaaattgatatggcggaaaagccaggcattatttgttatcagatagctcctcttgaagttaggatcacgactcgtcaataa

SEQ ID NO: 360 - DNA, 1065 bp, Papaver somniferum
atgggtagtagtatagatgctgaaacacatgaagttgacatcaaagatcaagctcaattatggaatataatctatggttatgctgattctcttgttcttcgttgcacagtagagattggaatcgcagatattatcaaaaacaataatgggtcaatcacactttcagagcttgtatcgaaactaccactttcaaatgtgaattctgataatttgtacagacttctaagatacttagtacacctgaatatcttaggacaacaaacttgtgctgctggagttgatagggtttactcacttaaaccagttggcacattattattaaaagattctgaaagaagcatggcaccagtaatattaggcctgtcacaaaaagatttcttgtttgtatggaatttcgtgaaagaaggattaggcactggaagtacaacagcatttgagaaagcaatgggaatggatatgtggaagtatttagaagttaatcctaatcaaagtcagttgtttgatgaagggcaagctggagaaacaagacttttaactaaaactctacttgtagattgtagagatacttttcaaggtatggattcgcttgttgatgttggtggaggaaacggtacgacaattaaggcaatccatgaagcttttcctcatattaaatgtacgctttatgatcttcctcatgttattgctaactctgatgatcaccctaacatcctaaaagttcccggtgatatgttcatgtctgttccaagtgctcaagttctcttactcaagtgcgtcttgcatgactggactgatgaacactgcgtcaacattctaaagaaatgcaaagaagcaatcccgaaagagacagggaaagtgatcatagtggatgtagcacttgaagaagaatctgaacatgaacttacaaaggcaagattgattcttgatattgatatgttggtgaatacaggtggtagagagagaactgcagaggattgggaaaatttgctcaaacgtgcaggctttcggtctcataagatcagaccgattcgcgctattcagtctgtcattgaagctttcccatag

SEQ ID NO: 361 - DNA, 528 bp, Papaver somniferum
atgtgtgtacactatgagttgcctgacaaccatctgcacactccccggttggttgagaaagttgaacttccagaaaaggcaataaccgaggctgatatcgtgaagcaaccattgtggcatgaatacgaaggctgggagcctccccgagacagatcgcagattatccagagcgaatgtaaacaagtaaccaatgctaagaggtctgtgcctgaactgaatgataatgaggcatggagaggagctggcactggtttcagtgctggaagggggaaaacaattcaaaagacatcatgtccagatactaatatccagccgtctactgcgggaggtggactgaacaatgggaagggccgcagatcttatcctaacagaggaaaagcttttacgcaacgagtgtcttcttacgacagctacaacactcgtagccgctttcaaccctctcccgctgctaatgactcttcaagtggtccctcatatgtggcacgtagtccgtcttatgtggcacaacgttggagtggtgaaccatga

SEQ ID NO: 362 - DNA, 231 bp, Papaver somniferum
atgtttctcaatccgtatgagcatcccaaatgcaatctcaaccgtcaagatcttttcttaatccgtatgagtggatcaaacgaaacctggtccgtcgattcttttggttgtatcaccaaaccctccctcaacactcagaactctaattcctatctattttttctctttcttcctctccgtctcttttctttctcagcctgcgccataaagagttctaatgagtattcataa

SEQ ID NO: 363 - DNA, 1185 bp, Papaver somniferum
atggctggtttctccagtactccagtccacatctccatctttctcttttctctctgcattctctctttaagctcattgtcatggagtagcagtggtagtaatctagagagacaaaatgatgattacgagaaatgggtatcatggaatgtcgaaaaccataagaaaaagattagtactacttgggaaacaaaccaaggcatggttacggctggtcaccggaaaagaagcggtagaagtgttgtcgactcaaagctaaggagggctgacttgcgcacagtgaggatgtgtgttagtcaggatggaagttgtgatttcgcatctatcagagaggctattgattctattcctttgaacaatacaagaagaaccattttggatatcaaaccaggtctatacagggagaaaattgttgtccctctagcaaagcctttcattactttcatgggggattctcagaacccacctaccataaccggaaacgacactgcatcaacgataggagatgacggaaggccattgacaacatttcatagtgctacggtcgcggttaactctgactattttgtggccatcaacgtaatatttgagaacacagttccacacgtgactggaacattggcagagcaagcagtagctcttcgcatatccggaaacaaagctgcattctacaattgtacgttctatgggtatcaagacactctttatgatcataaaggacttcactatttcaagaattgcttcattcaaggatccgtggacttcattttcggttacggtagatccttatatgagacttgctatttgaactcagtagcaacaaaggtagcatcaatgacggcccaaaagagaacaaactcatcattgtcaagtgggttctcatttaaagacagtgtagtaactggtagtggccttctatacttgggtagagcttggggagatcgttcacgcgttatattctcatacactttcatggacaaagttgttctttctcaaggctggaatgattggggagatcaaaaacgtgaacggagtgtctactatggagaatacaaatgcagtggccctggtgcaaatgccacggggagagtgcagtgggcaagattgttgagcgaccatgaggcaaagccgttcatcggagcatactatatcgatggagacgcttggctcacgagccagactctataa

SEQ ID NO: 364 - DNA, 627 bp, Papaver somniferum
atggcagcagcagcggtaacaacaccagtagttgagggaaccggtgcaccccaatatgatgttaagctcttcaacaaatggacgtttgatgaagtcgaggtcagtgacatttcattggtggattatgttggtgttgctgctaggcatgcaacatatgtcccacacacagctggtaggtactcagcaaaaaggtttaggaaggcccaatgtccaattgtggagaggctgaccaattccctgatgatgcatgggcgaaacaacgggaagaagatcatggcagttcgcataattaagcatgtcatggacatcatccatctcctcacagaccaaaaccccatccaagttattgttgatgctgtcatcaacagtggaccaagagaggatgctactcgaattgggtcagctggtgttgtaaggcgtcaagctgtcgatatctctcctcttagacgtgtcaaccaggccatctatctacttaccactggtgcacgtgagagtgctttcaggaacgtcaagaccatagctgagtgcctggctgatgaattgatcaatgctgccaaagggtcttcgaacagttatgcaatcaagaagaaagatgagatcgaacgtgttgccaaggcaaatcgttaa

SEQ ID NO: 365 - DNA, 1227 bp, Papaver somniferum
atggaaggtaaagttggaggaggggtaggaggagagataagaagagttcatatcatatattttctgagtcgaatgggtcgagttgaacatccacatctcattcgagttcatcatttgagtaaaaatggtgtccatttacgagatgttaagagatggttatcagaattgagaggaaaagatatgccagatgcatttgcctggtcttacaaaaggaggtataaaacaggttatgtttggcaagatttgctggatgatgatcttatcagtccaatttcggacaatgaatatgttattaaaggatcagaaataactacactttcatttgatccctgtttccacggagagaaaaaaggttcaaccttagcgaaagcagagacaattacttcaattgaagagattaaatcaaaaatcccagatagcaaaagtagtaatggaggagaatcccaatttgatggtgaagattcaggaccgttagattcagaaacatcaacagaaagtagtgaatcaatcaaagaaagaaactctgatgacgatcatcaaaaacagaggagtattgttcccattactgagattaaagaattaaatgatgaaactgagaattctttacaaaagaatgataaaaatgaaattacagagaaacagaatccgtcatcatcatcatcaacgacatcaacagcaagatcttcttcttcgtcgtcatcttcatcttctttcaataagagtaagagttattcgagtggtggagctactaatgtgtttcgaagtctactgagttgtcgtgcaacagatataaacgattcagctttgatgatgatccgtagaagttcttgttcttcttcttcagagatttgcaaatttgagaatttgggtgggtctgacacgaatactagtggaatattatggaatcaacatcaatcaaggagaagtatcagtaaaccatcatcatcatcatcttcagagaacagtacatcaaagaagtcaaatgaattcggtggtagcctgaaaaaagtctctgctgctttcaaaccagttgctgagcctcactgttcgcaatgtgggaaggggttcaagccggagagattacactcacacatgaagtcctgtagaggattgaaaagcctgagcaagaatcgcaatagtgctacagctgggtatgattttgagactgagcagaagttcacaacattaggatcttttaaagaaagaaaccaacagggatgtttttaa

SEQ ID NO: 366 - DNA, 549 bp, Papaver somniferum; identical to SEQ ID NO: 221

SEQ ID NO: 367 - DNA, 363 bp, Papaver somniferum
atgaatcgtactttgctggagaaggtacgatgtatgttatctaatgctggattaggtaaggagttttgggctgaggcagttacgtgtgcgtgcttcctcattaataggtttccatcagctgtattagaaggtaaaactcctatggagaagtggtttggtaaaccagcttatgattatgactcaatttatatctttggttgtcctgcgtggtatcatgttagtaaaaacaagcttgatagccgtgttgtaaaaagaatctttgtgggtatgaagagtggagtaaaagggttcaagatttggaatccagttgagaagaagatagtcatgagtatagatgtcacatttatgagatgtctatggtaa

SEQ ID NO: 368 - DNA, 1839 bp, Papaver somniferum
atggaggaagaagaacaaccaattgagatcagagctttgaaatcattaggtttagggttcgatttaacatctgattttagattaaagtttgctaaaaaaggaaacaaaggtgaagatgatggtattggtaggttgattgtgcttgatgaagaagatcaaagagatgttgttcttcctggtggtaaaattatatctggtgtatctagagatattaaatgtgataaaggagatcgtattaggtttaaatcagatgtggttgagtttaatcagatgtcagagttacttaatcagaagtctacagtgcaaggaaaaatcccttcagggtattttaattctatttttgattttagtggtctctggatggctgatgccacagacactaaatatcttgcctttgatggttacttcatctcactgtactatttgcacctaacgacatctccattagtgctccaagggagaataaaaaaggctgttccttctaactgggatcctgcatctctctccaggttcatccgtacatttgggactcacataattgtgggattggctattggaggtcaagatgtagtgtgtgtcagacagaaacattcttcctcaattcctcctgcggatcttaaacaatatttagaagaccttggagattcttggttttcagacggtggaagcacctctccattccgaagaactggagatgcaaaaagaaaggttccggaggtgttccagcgagttctgcagtcgaataggatgcaattgaacagaatcacagaaacatcaagcaaggatggactcactgttgtttgctcaaaaagaggaggggatgcttatttacatactcatcacaagtggctccaaacagtagcatcaaatcctgacgctatactctttaaatttgtacctattacgtctcttctttctggtataccaggcagtggctatcttagtcatgcgattaacttgtacctccgctataaacctgatccaaaggatttgcaatacttcctggagttccaagttccaaggcagtgggcacctatgtttaatgagctgcctcttgggcaccaaaggagggcctcttgtccttctttgcagttcagtttcatgggatcaaagcttcatgtcaactctacgcaggtctcaagtggcaggactcctgcggtaggtcttcgtctttacctagaagggaaggcatgcaaccgcttggccatacatgtacagcacctctcgaaccttccaaggttgcttgaatcttcatgggctggccccactacgctgaaacaatgtcaatggcgagggtctgatgaatccagtgtcccatacttagaacccataaaatggaaaagatactccaacatttgcacatcagtcgtaaaacatgatccaggttggttgcatggagaatcaccaggtgtattcattgtcactggagctcaactcatgaccaaggggaaatggccaaaacacattcttcaccttcgtttactctacacacatattcctggtttcagcatccagaaaacagaatgggcagttgcaccagcatcttcacaaaaatcaagtttcctcaccaatttcagcacaactttcacgacttcaggtccttcaaaggcagctcctgtggtagctataaattccggagtttattctgatggccctccaagaccagttcactctcaaaagcttcttaaatatgttgagacgtcagaaatagtccgggggccacacgatattcccggacactggatggtaattgctgctaagctagttacagaaggtggcaagattggtttacttgtaaaatttgcattgcttgattattccagtcccacgagtgagtag

SEQ ID NO: 369 - DNA, 564 bp, Papaver somniferum
atggtgttgtttagtagaaaaggagcatctgggttctcagcttgtaatacagctgaagaagtgactcagggtattgatggctctggtcttactgctattattactggatcatcaaatggtattggtgctgagaccgcacgtgttcttgcaatgcgaggagttcaaattgtcatggcagtgaggaatacggccgcgggtacggctgtaaaagaaacgatattgaaggaaacaccatctgctacaattgaagtgttggagttagatcttagttccatggcatcagtgagaaaatttgccggagagtttgagtcattgggtcttccgctgaacatccttgttaataatgcaggagttatggcactgccttacaagctctctccagacaaaatagagcttcagttcgcaacaaatcatctaggtcattttcttttgacaaatcttctgttggagaccatgaaaaagactgcatctcaaagtaacatagaaggaagaattgtcaatatttcttctgaagctcacaagttagcatacaaagaagggattcgcttcgataaactcagataa

SEQ ID NO: 370 - DNA, 597 bp, Papaver somniferum
atgatttctttttctttagttttagataatagtttatctaataagatgtttctacgtcattttttgtgtctttcggcaatgtttcttcgccattttggggcgagttttcttcatcattgtggggcgaattctccaatctttgatgaatggttcatggattgctactctcgattcaaaagtatcaataatttgacactcattcctgtgaggagcatttcttatcgtggaagaatacaaacaaatcaaatggtcggaatcatctctctcttatatataataagaaattgggcatctctgcgggtaatcgctctttctctttgcaatttatctgtaattgatatccttatttatattaggattttgattatcttacaactgacagccctacttacaactgagtccgacaatcggatctcaattgatactaaaaacgttaatgctagtactgcctctaacaatcatatgaaatgtgttttctttttctttttattaacttggtgggatttaatatacctgatggtggaaggtgacaaggtgtggagaactgcctctaacaatcatatgaaatatgttttctttttctttttattaacctag

SEQ ID NO: 371 - DNA, 1074 bp, Papaver somniferum
atggatatcaaattagaagatgaagaacaagaaataaaataccaaggtcatgtttggaacatgatctgcggtagtgtgaattcatccgtacttaaatgtacgattgttttaggtcttttcgatacaattcataattcatccaaacccatgaccctatcctccctatcatcagcatcaccatctttatctcctctcaaaaccgaaaacttatatagactattaagatacttatctcatatgaatctcatcgtaatcaattcaattcaaggaagtgatgatacattttcattaacagatacatctaagttactacttagtaatcaagaaagaagtttgaaggattgggttcttggtatcgacgatccactcgcaattaacgggtggcatgagttaactgattattgtttatcccccgttgatgcgccggttccttttgtaaagatgcacgggaaaaccatgtgggagtttgctgcagatatccctgaagttaatgagctaatcaataactccatggcttgtgatactaaattagtaatgcctgcatttttgcaaggttgccgtggtatcttgaataaaggtattgttaagaagatggttgacatcggtggtggtacaggtgctgctatgagttatgttgttaaggcttttcctgacataaaatgtatggtttttgatttgcctcatgttgttgctaacgcaccggagattgaaggtgtggaattggttggtggtgatatgtttgaattcatccctcctgctgatgctcttttgttgaagttcattctccataactgggatgatgtcggatgcatacagctactaaagaagtgcaaggagacaatttcagctgagcatgggaaagttatcataatagaaatggttttggatcaagacgaagatgacaatgatttgacacaagctagattgagtcttgatctagatatgatgctgagttcaggaggaaaagaaaggaccaaagatgaatggagaattttacttgaagaagctggtttcagtaagattgaattcattcctatttttgctattcagtcggttattgtcgcatatccttag

SEQ ID NO: 372 - DNA, 549 bp, Papaver somniferum
atggattctattaattcttccatatacttctgtgcatattttagggaaccaatcatcaaattgttgatggctcctctcggtgtttcaggtttagtcgggaaactttcaactgaattggaggtcgattgcgatgctgaaaaatattataacatgtataagcacggagaagatgtaaaaaaggcagttcctcatctttgcgttgacgtcaaaattatcagtggagatccgaccagttcaggttgtatcaaggaatggaatgttaacattgatggtaagacgattcgctcggtagaggaaaccacacacgatgatgaaacgaaaacgttacgtcaccgtgtatttgaaggagacgtgatgaaggatttcaagaagtttgatacgataatggtagtcaatccaaagccggatggaaatggatgtgttgtgacaaggtcaattgagtatgaaaaaaccaacgagaattctccaactccctttgattatctacaattcggccatcaggccattgaggacatgaacaagtacttacgcgattctgaaagtaactga

SEQ ID NO: 373 - DNA, 1014 bp, Papaver somniferum
atggaaagcaatcaagaatctttctggcaattcagtgatcaactaagactgcataactcaagctttgcgaatctcagcatcaatgattcaatatggggatcatctctcaattcaaagaagcctgaagagaggagaaacttcgatatcagagttggtggaaatcgaaatgattctacctttccttcttctaacaagaatattgattacagtaataatactaaacaagtgcagcagcagcagcagcagaaaaatggggcggggtctgattatctgaatggattcaatgatgcttggaaaattgcgactaagtttggtggaattggcgatggaggatcatcgttgatgcagaagaatatgaattttaatgttaatggagggtttaacaaaggtgtttattcgaagactgacaatttcaaacagagtaatacgaaaattgttaacgacaacagcaatcacaagaagaatgaagaagtttatgaaggaaaattcggaaagaaaaacaacaataacaacagtaacagtaacaacaacaacaataataataagaacagtgtcgataagagattcaagacacttcctgcagcagaatcacttcctaggaatgaaacagttggtgggtatatctttgtctgcaacaacgataccatgcaagagaatttacaaaggcagcttttcggtcttcctccaagatatagagactcagtcagagcaatcacacctggactgcctctttttctttacaactactctacccaccaactccatggaatttttgaggcttcaagttttggaggaacaaacattgatccaacagcctgggaagacaaaaaatgtcgtggagaatctcgtttccctgctcaggtacgggttcttctgaggaaaatatgtgagccactagaggaagactcattcaggccagtccttcaccattacgacggacccaaattccgtcttgaactcaacataccagaggcattagctctcttggacatattttccgagaacagtccttga

SEQ ID NO: 374 - DNA, 1911 bp, Papaver somniferum
atggaagctctgcaaatctcatgtactgttgttacttgtaaatcatcaccaacaacaacaacattcaaacccagaagtaccacttcactaaaaaaatcaaacatttttggtattactaatagtagtagcggggttttactgtcactgaaaacctcaattacagacagagaaatcagatttcgatgttatcaagatgggatttcaatttctgatgcagaagaaattgatgcaaaagataaagacggcatttttatgacttacaagaaaaaaactgatcctggggtttctaaaattggtgaagtgattgctgagtctgtggctgatgttggtgaagctattgaagaagtggtgaaaccaaaagcagcaggagagacatacagcattgttgttgtatcatcagaggcggtgccgtattctaaaacaggaggtttaggagatgtttgtggttcattacctattgcgcttgctgcgcggggacatcgagtcatggtagtgtctccaagatatgtgaatggtagtgcttccgataagatttataaaggtgcacttgatgcgcaatgtaggattaagattccgtgctttgaagctgagcacgaggtcgcattcttccacgagtatagggcgggtgttgattgggtgttcgcggatcacccttcttaccatagacctggaaatccttatggggatcaatttggtgcttatggtgataatcagtttaggttcacgctactgagccatgctgcatgtgaggctccgttggtacttccactcggaggcttcacatacggggaaaagtgtatgttcctcgttaatgattggcatgcaagtcttgtaccagtcctcttggcatctaaatatcgcccatatggagtttataaggatgctcgcagtattcttgcaatacataacctcgcacatcagggtgtggaaccagctgcaacttacaagaattttgggttgccagctgagtggcatggaacattagaatgggtatttcctacttgggcaagaactcatgcccttgatacaggggaagctgtcaatattatgaagggtgcaattgttacagccgaccggattctaacagtgagcaagggttatgcatgggaaataacaactgttgaaggtggatatggtcttgacggactcataagcagtcgagagagcgttctggatggaatcactaatgggattgacgttgatgagtggaatccatcttcagatgtacatattcctttccattactcaatcgatgacttatctgggaagcaagaatgcaaggcggctttacaaaaggaactagggttgccagtcaggcctgatgtcccattgattggattcatcgggagattggactaccagaaagggatagatatgattgaagcagcaatgccagagcttatgatggacgatgttcagtttattatgcttgggtctggtaatgcgcgtatggaagactggatgaaggcaacagaagcagcttataaggacaaataccggggttgggttggatttaatgtacctatttctcacagaataactgcaggagctgacatattgttgatgccgtcaagatttgaaccttgtggtctaaaccagttgtatgctatgagatacggaactatacctgtggtgcattgcactggaggactaagggacacggtggaaaacttcgacccttttgctaatgaaggcagcggtaaaggaacaggatggacgttttcaccattagcgaaggaccctatgttgggggtgttgagaattgcgatggacacgtataggaaacataaagattcgtggaagggattgatgaagagaggaatggaacaggactttacatgggacaaagctgcagctcagtacgaacaagtttttaaatgggctttcatggatcctccttatgttaaatga

SEQ ID NO: 375 - DNA, 1428 bp, Papaver somniferum
atgatgggaatgtcgaagaaaaagaagacggcaaagaactggttcacctctgtcaagaatgccttcaagtcctcagcaccaatatcatcatctccttcatccaaggattactctttagccaataagataatagaggagggacacgagataccggagattgtgtcgcttgaacattatccggtttgcgatacttcgtctctgacgacgacaatagatgaaaataatgctgaagcagtactagagatgagagatgaagatcgtagacgaagtaatcatgcgatcgcaatggcagttgttgcagcagaagcggcggttttagctgcccatgaggctacaaaggtgtctaggttttctagttataatcgtcgcaggttttatggttactctaaagaagaaagagctgccaccaaaatacaatcccattacaaaggatacttggcaaggagagctttgaaggcactgagaggactggtgaagctacaagcactagttagaggacacaatgtcaggaaacaagctgagatgacaatgcgatgtatgcaagcaatagttcgtgtgcaggcaagaacaaaagctgaccggctccggttacaaggtgcaacttcacacgacaatgagaaaaataaagcgaaaaagagtgcgacggagacgtggaataatagtcggggcaggcagcagcaggcgcgcaatagttttagctttgagaaagaatactcgaggtcgtcgactcagaagatgaacaaacaggaaaattatctttcgagtaattctatgacgattaaaaacgaaagagcccttgcttatgcttatccctaccaggactcggtgtcaaaccgtcagaactcggttgattcatattcggatgaaaaaacaaaccaaggtggctggaacttgttggatcgttggattgattcgcaaccatggcatcgtgataaacatgtcgcagcaataccggagagctcttacaccagccgtacgtataacaccgacgatgataatgcgtctgaaagaacggcagatacggacttggtatcattatcaccaagttatcagctccggtttaacccaatttctaacctgtcaaagctcggtataaactcggctggctcggtcccgatacgccagcggaaacaaagagttatggtttcggtggaaacagaaaatgtgaatacaccgagttacatggctacgactcagtcagcaaaagcaaaggcaaaatcggcacagaattctttattaagctcttcatcatcaactaggaggatatttttgaacgatttgtcaatgagttcaagcactgatggaatcggaaccggagaagtgaggacaatgaaccaactaggtccaattaatagcccaagtccaacaagtagtcaaaagatgatgcgtttgttgaagatgggaaagcccattaaaggagtaagatag

SEQ ID NO: 376 - DNA, 552 bp, Papaver somniferum
atgaagatttcatccggtactagatccaaactcaagcaaatagaatcaatatctctgttcttagatctgcccgaagaggttcatgatgagatctttctgaagttgcccgcaaaatccatcctggtatccaggtgtgtatgtaagcttttctataatctactttctaaacctaattttatcaaaaaccatcttaatctcactgttcaaactaaaattaacaaccccaaacttttgtttagtcattactcgcgaggtaagcaccctacgatttactcaattcccatagattatgcttcaatttcatcatcatcatcagtgacatcctctttattatgtgaatgtgatggagctgttctgataaattacccatttgaatccaaggaaatgaattatcttgaatttctgggttcacttaatggtctgatttgctctaggatttctaaaactgatagagttgcttatgaaaagggatattttctggagacggattattttagtattttgaacccattaacaagagaatttaaggaatttacaaagcctgagtatagt

SEQ ID NO: 377 - DNA, 3951 bp, Papaver somniferum
atggatctagctacaattttcgtatctcctatactccaagatctaatccccaagctgttaacttattgttctgatgagttcaatcttgtttggggttggggtgtcaaagatgatctgagaaagcttgctcagacattaaaaaaaattgaagctgtgttgcatgatgctgagaagcggcagggaggaaatgataagctagtgaaaatttggttgggagagctccaggatgtggcctatgatgctgtggacatttttgacgaacttcatattaaagatcttgaacagaaaaagaaaactgtaagtaaggtcttcccctgtttgcccttaaaaccatttgggtttgattataagatagctcttaaagtcaaagatgtcaatgaaaagttggatcgcatcaccaaagatatggagagattcaattttaccagtcagttcgggagtagtagtacttctggttctaatattactgttatgaatgaaattcgagaagaaacatcttcacatattagtgattcatctgctgttgtgggaaggatagatgaaaaattggaaattataaaactattgaaccaagatgattattctgttgttcgcattactggtatgggagggatgggaaagactacacttgctcagttcgtatatgctaatacttctgatgatactttcgtggtcaaaaagtgggtatctatgtacgggaaaacaaaaccagaggagatatttttggacctcttggagcccaaacctgaccgccgatcaagcttggatgaaattaaagctagcctgaagcaaaaactcatggtggggaaatccctgatagtactggatgatgtgtggacaaatcatgggatcgacataaaaaagttgctgaaagatatcttgtctatgagtagtctaagaattaaaattcttatgactatgcgaagtactgaacctattcctccgctaacgggttgtcgatacaagacctacccgttacaaggtttagttgaagatgattgttggtctatcattaagaaaaccgcatttgcacatggaggtgcagaggagactgaagatctaatcaacatagggaggcaaatttcgatcaagtgtggaggtcttccgctagcagcaaagactcttggaggtttgctctactctaagaagaacgtagaagattggttatttatcttgaacagcaaaatctggaatctccctccaacagatgataagatcatgtctatactgaagttgagttatgatcacttatcaccggatgtgaaacgatgcttttcatattgttcgatttttccaaagggtcatgtgttttcgaagaatgaagttatcagaatgtggatggcagagggattccttattagtccctggcaagcaaatgagtctccggaaattgtaggtaacggatatttcaagattttgttgctcaactcttttttccaggatgagcgcagaaacatttggggggacatcaagtcattcagaatgcacgatcttgtccacgatctttcagtatcaattacagggtgtgagtctcttaatataacaatagatgatattccaaagattgatcaatcttttacgtttcgtcgcttagggttacaagtccttcattctggtgtctcaacagcaattccgtcagagatttataaagccttcaaaaaactacacacttttgtttattctggactccatgatggtgaagatgtctgggcaaggcgcgtctgcaccttcggtttcataagggttttaaaattaagtcacacgggaattgaagagttgcctaaatcaatttgcaaattaaagcatcttcggtatcttgatgtcaaaagatgtaatagattgaaagagcttccccaagacatcagaaagctgatcgggttggaatatctcatattcagaaataagtatacgttgagtgctaaaatgccaagaaaggtaagcagattgagtgcacttaaaaagttatctgtatttatcgtgggagaagaaggcaaaggttctggtatagaagaattgaaagatctaaatcttcttggaggtaaactcagtatcgaagatttgggaaacgtaacagatggcacgcaagcaaatttaatggggaagaaaaatattagacacctagaactgagttgggattcacggggttgtaatgatcctgatagaattatcaaagatgttgaggtgattaatgacctccaacctcacctaaatctgaaaaagttgggagtttcacattttggtggttcagagatccctacatggttgaggagtgcttccgtacatcttccaaagttggtatctatcactctgtatcggtgtaatgagtgtgaacactttcctgcacttggaggactacagcatcttaaatatctttttatggatggatttggaggtgtcaaaagaatcggtaatgagttctgtccaagtaatgaagaagcagtatcattcccttctttggtactactttatatttatcattacacaaattcggtgaactctgatcggagtagtcgagcatctactttctcttggtctgaagatttggagaatcaaaatggttcaacgctgtcaaccacgccaacagagtttccatttcttagaaagttatattttcatattgagcggcaagtggatgccaacctcaagtctctatctccaaaactgctttggggggttctccagactttactggtcgctgggtgtaatgagttcgtgggctttgagcagcaacatcgtcatcaactagatcatctttcttacagccatcttcgtaggctagaagtttttaaatgcccttctttaacggtattgcctgcagacttcagcggattaaattctctgacctatttagctattgaagagtgcagtagtcttcactcattgccagatggaatacagtacctcccggcacttgagacactcataatcggtggcttttcagaagacttaacatcttttccatttccagcggcaagcggatctgatggtgaaaaatacttcgtttccctccgtgtattaaagatatgcgggtggcctactctaagtgccgagttgccggaccaacttcaactcctcacttgtttacagtgtttcactataagaggttttccttgtctatcgagtttgcctgagtggtttcgagaattatcttccctccagaatttgtactttctaaattgcagcaggctgcagtatcttccttctgacgaacagatgcaacgcctaacgtccctgaaaaccatatacatttggaattgtccactgttgcttgaaagatgttctggcaatgaagaagggcataagattgcacgccgcaaacaagttattggatcatctccctcactgcttgaccacattccacgggatgcagacatgaacctagagcttcttgcacgtaggacgtctgggatattctcaaatcaaaacaaagagaaacgctggattgatagttgtggtcgcaagtgcttcatgttttttccaacgagtttctatatcgcatggggggacgacacacgctactggacatggctttcagtaacagagccatcagcagcaagtaacaatgcagagattgaagtgcccgagcttataaaagtatgttggcttgacgtgcatgggacactggacatgtcaaaactcactcctggagtaaattatgaggttgtatttatagttatgcttcgtgaacgaagttacggatggggcaaacccgtgaacctttgcctagtactcccagatggacaaagactagaccagacactggtcttagaaactatgcctaaatcaacgtggatcgagattcacgttggagatttccaaacaccagaacaacagcctggtgatcaagaaaaacaagtcaaatttaatctgtctgaacaggaaacgttgttctggaaaagcggacttgttatcgaaggagccatcgttcgacctaaaaaaagtagctcttaa

SEQ ID NO: 378 - DNA, 351 bp, Papaver somniferum
ggaaaacaacaggtagaagaagaagagcaagaagaaaaggaggtagaagaagaagaagaaaaggaggaagaagaagaagagaagaaaaggaaaaggccaggggtttctgttaaagaatatgaagataatggtgatcttattatttgtcagctatcaagtcgaaggaaggtgacaattcaagagtttaaagggaaggcattggtatcaataagggaatactatgaaaaagatggaaaggagcttccttctactaaaggaataagcttgacagcggaacaatggtttactttcagtaaatctgtccctgggattgagcaagccattaagaagatgcagacaaggtctcggtga

SEQ ID NO: 379 - DNA, 378 bp, Papaver somniferum
gcatgttgtgtcctgtatctggttggacgtaatctttatgctttcttgcaaaaacttttggaagtcctgagatgtactctgttcatcattgttgatcttgcggttttctgcttcagatatgacgctgttatggaaagctggcaacttacattcaactggggccaaggggttgccttccagatcagggatgtgaagacgcgggtattcacagacatagcttgggttaccatgaaaacttatgttgacgatcctaatagtgggccattcaatgtgaccaatgtttacgagtttcacaaagggcagtggtacttggttcaccatcactgctctgtgatactaattggcgcagaggctgatcagcaaaacgtatttggatag

SEQ ID NO: 380 - DNA, 390 bp, Papaver somniferum
atggcaaacagaggaactgcttctaataactcggcactcatttctatgattgctgatgaggacactataaccggattcctgctggctggagtgggaaacgttgatttgcgcaggaacacaaactacttaattgtcgactcaaaaacaactgtaaaagcaattgaagatgcattcaaagattttatctcaagggaggatattgctatcgtcttgattagtcaatatgtcgcaaacatgataaggtttctagttgatagctacaacaagcccgtccccgcaatccttgaaattccatccaaggaccatccatatgatgcacaacacgattcggttctttcacgagtcaagtacctcttttcttctgaatcagtggctggagacaggcggtag

SEQ ID NO: 381 - DNA, 933 bp, Papaver somniferum
atggaaatggataatattgaatgtgtatcatcaattgaagaaggaggagaagatattcatcaacatcatcaatttggttcttcaaaacctttaattaataatttgatttctcctgctacaagtgtttatgaattgcttgaatgtcctgtttgtactaattctatgtacccacctattcatcagtgtcacaacgggcacacgctatgttcaacatgtaaaacaagggtacataaccggtgtcccacttgtagacaagagcttggagatatcaggtgtttagcgttagagaaggttgccgaatcccttcaacttccctgtaggtatggctcgctagggtgtcctgatatatttccgtattacagtaagctcaagcatgaggctatgtgcaactttagaccatacaactgcccctatgctggatcagagtgtgcaattgttggcgacattccgtcactagtcacccatcttagagatgatcataaggtagatatgcacactggatgtacgttcaaccatcgatatgtaaagtctaatcctcgtgaagttgaaaatgctacatggatgttgactgtcttcaactgttttggtcagtacttctgcctacactttgaagccttccaactcggaatggcccctgtttacatggcattcctgcgcttcatgggagacgaaactgatgccaggaactactgctacagtttggaagtaggagcaaatggtaggaaactgatttttgaaggtacaccacggagcattcgtgacagtcaccgtaaagtcagagacagccacgatggactcattatccagcgaaacatggctctctttttctcaggtggagataggaaagagctgaaacttagggttacgggaaggatatggaaggaacaacagaaccaagaagccggggcgtgcatcccaaacctttgtagttga

SEQ ID NO: 382 - DNA, 963 bp, Papaver somniferum
atggagatggataatattgaatgtgtatcttcatcagatggtggaggagggatggaagaagaagatataagaacccataatcataatcataataatcaattttcatcatcaaaagggttaaataataatgggatttctcctgctgctacaagtgttcatgaattgcttgaatgtcctgtttgtactaattctatgtacccacctattcatcagtgccacaatgggcacacactgtgctcgacatgtaaaacaagggtacacaaccgctgtcctacttgtagacaggagcttggagatatcaggtgtttagcattggagaaagtagctgaatcccttgagcttccctgcaagtatggctccctgggatgcccagagatatttccctactacagtaagctcaagcatgaggctctgtgtaacttcagaccttataactgtccttacgctggatcagagtgtgctgttgttggtgatattccgtttctggtcacccatctgcgagatgatcataaagtagacatgcacactggatgtacattcaaccatcgatatgtgaagtctaatccccgtgaagttgaaaatgctacctggatgttgactgtcttcaactgtttcggtcagtacttctgcctgcattttgaagcgttccaactcggaatggcccctgtttacatggcattccttcgcttcatgggagacgaaaacgacgcgaggaactacagttacagtttggaagtaggagcaaacggaagaaaactcatttgggaaggtacaccacggagcattcgcgatagtcacaggaaagtcagagacagccacgacggactcataatccagcgaaatatggcactatttttctccggcggggacaggaaagagctgaagcttagggtgacagggaggatatggaaggaacaacaaaaccaagaagctggggtgtgcataccaaacctttgtagttga

SEQ ID NO: 383 - DNA, 1581 bp, Papaver somniferum; identical to SEQ ID NO: 9

SEQ ID NO: 384 - DNA, 1155 bp, Papaver somniferum
atgatcatcgaaacactagatatcctgggaccaaatcagaatggcaattcaggaacccatactcaaaaaccaatcaaaaccagaaactggctgctgatcattattaactgcgccttagttttttgtggtgttataggtggtcctctcttaatgagactgtactatcttcatggtggtagtcgtaaatggcttagtagttttctgcaaactgctggtttcccagttctcatatttcctctcatttttctctacattaaaccgaaattgtcaacacaaaacaacgatcaaagttcttccttttttatggaaccaaagttgtttctttggagtgccatagttggaatcgtgtttggtgtttctaatttcatgtacgcattgggtttatcttatcttccagtatcaacttcgacaattctctttgcaactcaactgtgtttcacagcaatttttgcatggttaattgtgaaacaaaaatttacagcatttattataaatgcagtgattgtaatgacactaggatcgatcttattgggtattaataccaatggtgatagaccaattggggtatcaaaaactcagtacttaatagggtttcttatgacgttagctgctgctgctctaactggcctcgggacgccttttgttgagctttctttcattaaagccaccagaaatattacttatccaactttgttacagtttcaagtcattctttgtctgtttggaacctgcctcaacgtcattgggatgctaataaataaggattttcaggctatacccagagaagcagacatgttcgagcttgggaaaagcaagtattatatgataatatgcttgactgcattgacatggcaattatcaggaattggactcgtaggcctaattttgtacacaaatgctcttttcaacggtatatacgtatccgttcttgttccgttcacagaagttgcagcggtcatatttttccatgagaagtttacgggattaaagggaatggcattggcattatgtctttggggtttctcttcctatttctatggagaatacaagatgatgaataaagtgggtgataatgaaacacatgagaaaatcgaggaagccgaaagcgagcccaaaagattagaggatcaacaagcaccatacagtactgtatga

SEQ ID NO: 385 - DNA, 318 bp, Papaver somniferum
atgcttgagaagaaggatggtcgtctaagcagaaagtttaatctgaagaagttgagggacacattttgtgacaccaagaaaatctttgataaggaaggaagggtgaacccggtgcgaatcaatgctaccgcgtcaggttatttgctatatgtcctgggcaaatgtatcttccccgacagttccggaagcttggtcgacgccagttatatgcaactattggatcccttagataagatgcatgagtattcttggggtactgcgatggtcgccttcttgaacaatgagttgacaaagggttctagggcactcactgcgtaa

SEQ ID NO: 386 - DNA, 441 bp, Papaver somniferum
atgaagttcaatcccagagtttcatcatcaaggaggaagaaccgcaaggctcatttcacagcaccatcaagtgttcgtagagttcttatgagctcccccctttcatctgaactccgcagcaaatacaatgtaagatctgttccagttcgcaaagacgatgaagttcaggttgtaagaggaactttcaagggccgtgaaggaaaggttattcaagtttatcgcaagaaatgggttattcatgttgagagaattacaagagagaaagtgaatggatctactgttaatgttggcgttaatccatcaaagtgtgttattactaagctcagacttgataaggataggaagtcgctcttggatcgtaaggccaaaggtagagctgctgctgataaagataagggtaccaagtttactactgatgatgttatgaagaacgttgattga

SEQ ID NO: 387 - DNA, 405 bp, Papaver somniferum
atggcgatacatttatacaaaacttctactccgagcacacgcaatggggccgtagacagtcaagtgaaatccaattcacgaaataatttgatctctggacagcagcgtcattgtggtaaaggtcgtaatgccagaggcatcattaccgcaaggcatagagggggaggtcataagcgtctataccgtaaaatagattttcgacgaaatgaaaaagacatatctggtagaatcgtaaccatagaatacgaccccaaccgaaatgcatacatttgtctcatacactatggggatggtgagaagagatatattttacatcccagaggggctataattggagataccattgtttctggtacagaagttcctatctcaatgggaaatgccctacctttgagtgcggtttga

SEQ ID NO: 388 - DNA, 300 bp, Papaver somniferum
atgactcttttgtttccctttgatgtggttatatacgcaggtactagaacagatgcctcgagtcatttcagcgctggatgcccatatggaaagtggactacagagcgttcctcatttgaagactgtgacacagttactgtcaaccatggaaagcacccagcttcagcaatcccttcgtgtgcatcagcctcaaaatgtatgattccatctaaccttatactcaaggtagtcaatatcggttgtttcggccgatattataggtttttatcgtgtatcggaaaaaaactgtacgatatctaa

SEQ ID NO: 389 - DNA, 384 bp, Papaver somniferum
atgtcaccttatcgtttagtgtttggcaaggcatgtcacctgcctgttgagatagagcatcgagcctattgggctattaagaacttaaacttttcacttgacaaggaaggagctcaaagaaagctccagttcaatgagttggacgagattcttagagatgcatacgatagtgctaaggagtataagaacaaaatgaaacttgtgcatgataggaatattttacgaaagtcattttctccaggtcaaaaagttcttctgtatgacactcgtttgcatctattctccgggaagttgcgctctcggtggaccggtccttttgtggtccgtactgtttttcctcatggcgctgttgagattgagacaccagatggtagtagttcttag

SEQ ID NO: 390 - DNA, 1797 bp, Papaver somniferum
atgggaaggacaattcaagtctacggtttcccttcttatgtgaatgcagaaatggtaaaagaattcctggagaactacactggcaagggaactgtgtatgcactagatattccgaagtccaaaaataaggggctaaatcctagagtttttgcaaatgtgcaattcataagcaaacaagatgccagacttatatcttctttgataaatcaacggctctattatggcaagtcatatttaaaagttagggatttggcgcgtgatgttgtaccaaagccaagggtttcaatgtttcatttgcaggcccctgctctgcattttgggtgccaggtttctgatgattgttttcacgtaatttggaagggactcgatgtgatagcggatttcgagttcgggtttcgtaaattaagttttcttttatcttatcgtgatgtgaactataagcttgaactttcttacgagagcatttgggaaatccagttgcgccgaccgaagaacttaagctcacaatttctcataattcagatgaatgctgctcctagagtttatgtggaaccactctcctcgttaggaaatccaggcagggatttacaatattttatgcatacatttgatgatcagtgggtaagaactactgatttcactgaatcgttttctattgggcagtcctccgcaatgtgtttgaaaattccatatggctgtaagcttccaaacttccgtgaaaatttccattattatacggaagatgagggtttgttcacaatgcagcccggttcgccagtttctcgaagcttggatctagttccttttgttgagcctcctgatggacataagctgcgatatgatattctgtttaaggttaattccttggttcagactggctgcctttctggtccaacgcttgacgcaaaatttttccgtatggttgaccctttctctcactctgtcaactacataatatgtgccctggagaaactgtttcacttgaaagactgttgttatgaacctgttaactggctttctgggcagtacttggagtacagcttatcagcaaaccctcctagatcaacttcgatttccttgtctgatgggctggtatatgttcgcagggtgcaagtaacacccttgaaagtatacttcctgggtccagagattaatgtttccaacagagttttacgctattatagtgaacacatcgataattttatccgtatttcttttgttgatgaagactcagagaaaatccgttcaactgatttatctgcgcgtgcaacaatgaatgacgagaaaaagcacactttgctttatgaaaggatactctctactttgcataatggcgtagttattggtgataagaagtttgaatttcttgccttctcagcaagtcagctacgtgataattctgcatggatgtttgcttcaaaaggttcgctaacagcagctagtatcagggactggatgggtgattttcgcaagattagaaatgtggcaaaatatgcagccagactaggacaatcttttggttcctcaacagaaacattaagtgtttctagggatgaaattgaaaagatagatgatgtcgagattgaaagtaatggaactgtatacacattttctgatgggattggaaagatttcttctgaatttgcacataaggtgacaagtaagtgtggtttgaaatgtacgccgtctgcctttcaaattaggtatggtggatacaaaggtgttgtcgctgtagatccaagaacagtgaaaaagttatatttgagaccaagcatgcgtagttcaagtcaaaggtaa

SEQ ID NO: 391 - DNA, 327 bp, Papaver somniferum
atgactactacttcctatagtgtaagtaaacagactcaacatgaatacctacagttcagcacgtcctatacaggttacttaacgaggacaatgatgatatatgaccagctgcggccttccatgaagctgcagttggtaaaggtttatcaggtgtaccatgtaacacttgaggaactgtcgaactgggtgacaggaacatggacaagaagaaaaataagcagctgggtatttgcagtaacaggggtcaaaaggaaattcagattgacaggagacatgagttggccgaattatgaccccaaaagaagcataccgggtttgaagtcataa

SEQ ID NO: 392 - DNA, 1020 bp, Papaver somniferum
atgggttcttctcaaggatctactactttgagtgtcaaggaattgaaaagagaagtttatttcattgattctttacctgtttatgttaaagaattgattgctggtggatatgctggagcttttgcaaaaactgcagttgctccattagaaaggattaagatactgttgcagactagaaccgaaggatatcattcgattggagtttggcgatcgttgaagaagttactaaaacaagaaggtgttcgaggattctacaaaggaaatggtgctagcgttcttcggattgttccctatgcggcattgcactttatgacttatgagcaatatcgatgttggatcttgaataactactctgcattaggaacaggacctatcgttgatctggttgctggttcagtagctggagggacagcagtcttagtaacctaccctctagatttagctcgaacaaaacttgcttaccaggttctgggtagaagaggtggtagttttggaaatggtatgagcagttcccaatcgctgccagcatatagtgggataagagatgtctttaagagtgtctacagggaaggtggggctcgttctttgtaccgtggaataggtccaacactcattggaatccttccatatgctggtttgaagttctacgtatacgaggaacttaagaggcatgtccctgaagaacaacagaaatctgttatgatgcgtctctcttgtggggctttagcaggactatttggtcaaaccttcacatacccgctagatgttgttaggagacagatgcaggttcaaactatgcaaccgtcaaatcatctaggtaatcccaggtacaggaccacaatgcaaggacttacctccatcattcgcgatcaaggatgtaaacagttatttgctggattaagcatcaattatgtgaagattgttccatcggtcgctattggtttcacggcatatgacatgatgaaatcgtatttacgggtaccacctcggcaaaaagctccgtctgcgtccgctggatga

SEQ ID NO: 393 - DNA, 1020 bp, Papaver somniferum
atgtctcgcggaagagaaaaacatctagatacagtatataaagcccgcactgtagttgcagaggacaccgtggtaaaacaagatcactacaatgtttcttctcatggaagaccggaagttgttccacagagagacaacgaacaactttggtctcgtagaagacgagatcacactgctgatgtggaaaaagagagaggtcatgaggtagcagataaggtctctgcggttaaggaaaaagagaaagatcgtgaggtggcagaaacggcgaaaccacaatacaaggcttttgcccctcctccttatgttaaacaaccaaatgttgtcaagaatggtattcaaaatgatacttttggccctgaaaaaacactattagagcctccggtgcatagaagatacatgaatgttggatcagagagaagtcatgatgaaaggcaggaatttcgacctgctaaggttaatcatgttaatgagcacagtcatcatgatgattctgttagtgaccgagcactaaaaccgaagccaatgtcagtaagaaggcggcagatgaaaccaccattaagctacgagaatcccaccagcattgaaggtgatgacactatgaggagagttccaagtgccaggaggagagaagcaagaaatggcttacagcacgctctagatgacgatcataagaaagaaaaggatgaagaagaactggcaatggatcaactactgatgcattacagcaagaagccaacaaaatacgaacccattatggtaaaagcaggattaagttcaaatgtccgtccatctagtcgcgatgaaactgaacggcagcgtccatctactcgcaatgaaactgagcggcggcgtccttttagagcaacgtctttgcctcctgaaccagcaactcctcctaaagaagcaggcaaagcaccttctcgcgccacttcgttccaacctgaacggttatttgtccatccgaatctaccggaatacgacgatttagcagcacggattgcctccctaagagaaaggtaa

SEQ ID NO: 394 - DNA, 509 bp, Papaver somniferum
atgggaaggacaattcatatttatggatttccttcttatgtgacagcggaactcatcaaggacttcctagaggattacaccggcaagggatctgtgtatgctctacaagttacaataccaaaaaataaggggccaaatcccagagcatatgcagatatacagttcacaactacccagaatgctgattatatgtctttgttgattaatcaaccccaacgcctatcctatggcacatcttatctcaaagtttttggcagggatcgggatatcatacccaagcctagggtctcgatgttccatctcaaggttccaactctgcattttggatgccaggtttcaaatgattgtttttatactctttgcaagactaaggacgtttcagtggattttgggtttggattccgtaaattgtgctgtctcttgtcttataaagatcccttgaagataaagcctgtgaactataagcttgaactttcttacgagagcatttgggaaatccagttgcgccg

SEQ ID NO: 395 - DNA, 3432 bp, Papaver somniferum
ctaaaccctaaattttgttttcttcttctcttctttctttgttcactactacctctactggcttccattatccccatcttgtttagaagactacctaatccacatctcaaggtttcaattaatgccctacacagactagcatcaaatcacagtttttgtcaaatggcgaataaagagacggatggtgcaaagagttatgctagaagagacaagttattgggaattgagagagatgttcaaacctggtgggatgagagtgatgtgtttctggcagaatcttgtaaaaatcctccaaaactaggtgaaaaattctttggaaatttcccttatccctacatgaatggattacttcatcttggtcatgcattttcattgtcgaagctcgaattctctgctgcttatcaccgattgagaggtgccaatgtacttttgccttttggtttccactgtactggaatgcccattaaggcctctgctgataaactggcccgggagattgaaagatttggaaatccacctgtatttccgtcgaaagaggaccaaattgttaacaaagtacaagaaccagaagttgatacaagtggaaaaactgaacctgataaattcaaaagcaaaaaatccaaggctgcgtcaaaatcgggtggtgaaaagtaccaatgggagattatgaaagagtatggactcgcagatgctgaaatctctaagttccaagatccatctcactggctcatctatttccctcctgttgctaaagaagacctcaaggcatttggcttgggttgtgattggcggcgatccttcatcacaacagatatgaatccttattatgattcatttgtcaggtggcagatcgggaaattgaaggagatggggaagattgtgaaggatttgaggtatgccatttactctccgttagatggagagccatgtgcagatcatgatagggcatcaggtgaaggtgtgctgccgcaagattataccttgattaaaatggaagtggttccacctttccctgctaaaatgggatctttggaaggaaagagagtgttcttggctgctgccacattgagacccgagaccatgtatgggcaaacgaatgcctggattttggctgaaggcaaatacggagcctatgaaatcaacgacaccgatgtgtttgtcgtcactgagagggctgccctgaaccttgcctatcagaacctttctaggatcccagagaagccgacttgcttggttgagctgattggtcaagatttgattggtttgcctgtacagtcccctctatcttttaataagatcatatacacacttccaatgatgaatgtcctaactgataagggtactgggatcgtcaccagtgtcccaagtgattctcctgatgattttatgactatgaatgatttggaaacaaaaaaagctctgagagaaaaatttggtgtgaaggccgagtgggtatttccttttgaggttgtacccataattaacatccctgagtttggggaaaaatcagctgaaaaggtatgcatggatttgaagatcaagagccagaatgagaaggagaagcttgctgaagcaaagaggttgacttatttaaaagggttcacagaaggaactatgcttgttggagaattcgcaggtatgagggttcaggatgcgaagccattgattaggaccaagcttctagaaaatagccaggcggttagttacagtgaaccagagaagaaagttatgtccagatcaggtgatgagtgtgttgtggcccttacagatcaatggtacatcacatatggtgaagaaggatggaggaaaatggctgaggaatgtttgtccgagatgaaactctaccatgacgagacacgcaatggatttgagcacaccttgagctggttgaataagtggggttgctcacgctcttttggcttggggactcgtataccttttgacgagcagttcctcgtcgagtccttgtcggattccacactttacatggcatattacaccattgcccatatgttgcaaaatggggaaatgtatggaagagatgcatctttggtgaaaccggagcagatgaccgatgaggtttggaattacgttttttgtgatggcctgtatcctaaatcatcaaccatctctcaatctgttctcaacaagatgaagcaagagttttcttactggtacccgtttgatcttagagtctctgggaaggatttgatacagaaccatctgacttttactatctacaaccacacagcgcttttaccccaacatcactggcctcggggttttcgatgcaacggccatattatgctcaactctgagaagatgtccaagtcaactggaaatttcaagactcttcgccaggcaattgaggatttttctgcggatgccacaaggtttgctctagctgatgctggtgatggtatggatgatgcaaatttcgtctttgacacctcgacatctgcgattatgcgactcactaaagaaatctcatggatggaggaaattctggaatctgagtcttcactcagatcaggtccttctacttatgcagatagggtatttttgaatgagataaatattgctgtcgctgagactgagaagaacttcgatgagtatatgttccgggacgctctgaagacagggttttatgacctacaagctgctagggatgagtatagattttcgtgtggaatcggtgggatgaaccgtgacctattatggcgatttatggatgttcaaacgcggttaattactccaatttgtccccactatgctgaatatgtatggagaaagctcttgaagaaggatggctttgtcataaaagcaggttggcccacagctggtatacctgatcttactttgaggagagccaacatgtatttgcaagacacaatagccagtatgagaaagttgctcgagaaacagatatcagggtcgaaaaaacctaataagaaggcgacgccagttacccttccaagtacagagaacaaacccacgaaagggctgatctatgtcaacgagcattatgatggatggaaagctgaatgcttgaatattctccgagccaattttaacactgaatcatgccaattcaaacctgattcagagattcaattagctttgaagcagagtaatgttggacagcaagcaaattttaagcaagtacaaaagctttgcatgccatttttaaagttcaagaaggatgaggcactttcagttgggattcaggccttggatttgaagctaccatttggtgagatggaggttctccaggagaatcaggagctaatcagaagacacttgggtcttgagcaagtacaagtgttggatgcattgaatgctgatgatattattaaagctggacagcatgccatcttgttacagcaaactcctctttcaccggggagtccaacttccatctttttgagctag

SEQ ID NO: 396 - DNA, 3045 bp, Papaver somniferum
gccagaattctgtttccctttcacagaagcgactctagggttttattttcttctctcatggaagaagtagcgatgaatccaaatgatttaaaccctaatactacaacacccatggaagaaatttctactatttccatggattcttcaacaacatcatcatcagttactactaccactaccacaatcacccaaatttctgtttctgaaaaactccaaattactgatgaacaagttagggtttctggttttggttctggttctttgttaaaacctttagtaaagtgttctgagaaggtttctgagagtaaatttcaagtggaaagtgttgttggttctgtttctgtacataaagaagttggagaaaatggaggaggtgttcttgaagaagtagaaattagggtttctgaaatggagaaagtagaagagatttctgatgttgttgttcttagtgaggaggaagaagagaaagaagatgttgttggttctgtttctgtaaataaagaaaatggagttgttgttcttgaagaaggagaaaatcgcaaagaaattagggtttctgaaatggaaactgaagaaggtgctggtgctattgaagaggaagagaagcaagatcttgttgtagatgatgaaaaaatggtgtgtgaaaatgtaaatggaggagatgagagtatgtctgctgctagcgaggaggaggaggatgccagtggaggagatgataagacttccactggagataacaaaatgggttctcctgttgatgatggtgatgagagtatgtctgctgctagtgaggaggatgtcagtggaggagatgttgagactactactggagataaagcagaagaagcagaggaggaggaggaggaggagaatatggttggagttgatgttaaggaagattcaagtttagctgctgagggtattagtggagctgttaaaactactggaaaaggaggaggaggaacaaaagctgaagagaaaggtaagaatcaagctcatgcatatgatatgggtgtttcgaatgttgtttgtactagtgttaatgactctaattttggtagtttagttgttgatttaggtatctgtaaaaacatgggtgaaattgtcaaacataatgaggaggggaatgaatattctgtttctgatttgatatggggtaaagtgagtagccatccatggtggcctggtcagatatttgatcctcaggctgcttctaaactagcgaagaagcatcagaaacatgataggaaaagacttttggttgcgtattttggggatcagacctttgcttggaatgttgcgtcgtctttgaagccgtttgaagctaatttctcacagatggaaagacaaactgatatggaagagtttcgttctgctattggttctgccttggatgagatttctagacgtgtacagcgagggttgctatgttcctgtgtaccagatgaagcttgttctgagatcaagtcacagataataacaaatgctggaattcgggccgagtctagtaggagagatggtgttgacaggaatgtgggtgctgctacatttgaacctggtaaggttgttgagaatatcaaaaactttgcactcaacccccttggaggatgtgataagatggaaaatgtggtaactcgagctcaattagcagccttctaccgttctaagggtcatccacgaatggctgagtatggtatctggggagggttattggatcccgattttcagatgccagctctcacttccaagactgaagaagcaccttccgagaaaagaaagcttggaagtcaggacaagcctcctagtacaccaacccctggtggcaaaaagcaaaagtctgttgggtccttctctgatgacttagcagggaaaactggcaaagaagggctttcgcagtcaagtaatgaggatgctgaatttcgaactccaggatctttcaaggttggagaaagcttacgtagagttgctagtcaactgaaaggatcccctccgatactaaattctagtggtggaaggtctcgaaaaagtgcatgtaagatagatcggagcagcgagaagctgaatgagaaatccaaaaagcgaaagatcaccattccaaaagaatactctgatccagatgagatgttatcacaacttcacttggctgcaagagatcctatgaaaggctacagttttctgaccatcatagttggtttcttcactgattacaggaattcaattaatttagaccagtccggttccgggaagaagaagagcagtcaattaaaaagtagtggtggtagagacggaaaactgtccaagtttgaggccaatgctgcggagatatatagtgatgaggaggacgacccttattggactgatatgattagtggaggtactcccgaagaacagtcaccccgcaaagttcagaaaagaaagcgaaaacccacgcctaaagccaagtctaagaaggattctagcactgttgaattggaaaaaaatcctccatcaagtccttccttagtgattgaggaatacagttccagcgacgaatcagaaggttccatttacactattgattctaagcagcctgatcctgatgtcagtaccaatttgattacagaagcaccagctgtaagtaatatcattaagaacaatgcagatgatccgtctcccactgcgctagtactgaacttcacacaggctgaatctattcctttagaaactgatctaaataagatatttagccgttttgggcctttgttggagtctgatacagaagtaaccaggaagtgttgccgtgctaaggtggttttcaagaatcgaaatgatgcagaagtagcattcagcagtgctgggaaattcagcattttcggaccagcgcttgctagttaccagctgaggtatttatcatcaacaccatctacagcttctccctgtccccttcctgcagcttctccctgtcccctgcctgcagcttctccctgtcccccacctgcaacttctcccgctcccctgtctgcaacttctcccgctcccctgtctgcaacttctcccgctcccctg

SEQ ID NO: 397 - DNA, 891 bp, Papaver somniferum
atggactatgatgcatcacctgctattgaattacatcacgatgttcagattgaggaagttgaggagtacttcgcaaattacatgataaatgacagcttaggagtcatcgccaatacccacaccgcctttgctgataaggagcagctgaaggcagagagtaaggaatgcatagaactcgccaagctattttcaattgctgtcgacttccctaagacaggtgtgcccgcagaaattcctcctcatttacgcgtcaaagaatacccagacttcatggaaaagcttgatagaccaacttatgagtcaaagcgagtgatgggcaaactttttaggcaggtcaaagatattgctccccacaccagccatataaaatccttcactttggaggtggcaaggaaatcatatgatgcagatatggaagttgatgggttcgaggattacttagatgatgcttggttccacaaaggagaatttgactacaagttggctaacctgatggattattatgggatcaaaactgaggctgagatccttggtggaagtgtaatgaaattgtccaaatcatttaatatgaggagagacgcagaatcgattagtctggcagttagagctttaaaaaaagaagcaaggacgtggttcgataaaaagagtatttttaactcgggttctcaggaagatgacgatatctatgcaaaggcttcagcgtggtatcacgtgacgtaccatccaagttacttcggaaactaccgtcaagagaagagtcgggaacatttccttagtttcccctggtgtgtttatgacaaactgattcacatcaagaagaacaatagcatgagaaggaaacacaactggtcactggaagaccaattcatgagcagtctaagattaagctaa

SEQ ID NO: 398 - DNA, 366 bp, Papaver somniferum
atggcagaatctaaaccagaacaaagtgcctgtcaatcagtggaagaagtaaaagccccaaatttgatggaaagagcaaaagaagaggtcacagcaattgctcatactgataggtcaccaaaacatcatatagaaactcatgggacaagtgatgatattgatgaaaacacaaaacctgaggaaatcaaaggtcctagtgtttttcaaagagctaaagaagaaattgaagcactagttgaagcaattcatccaaagaaagaatcatcatcatctgatgaccattcaaagaaggatggtggtggtttctttgcttccattgggaggagtttggagaaagtttgttcacctaaagggaagaaaacataa

SEQ ID NO: 399 - DNA, 311 bp, Papaver somniferum
atggcagaaatcgatttggagcttccagttattgaagcaaagtctgttgaagatcttaatgctgtcttgaagcagcttcacgagggagataactcggaagcatctgttgttaataaaccagtattgaaggaatctacagcttctgaccacatgcttgatgagccactactgatagaaacaaaagatgagctgggtgagttgacaccgtacacacaagagcgacatcttgcagaaaccgatttggagcttccagttattgaagcaagattcattgaagatgttgatgctgtcttgaagcaactccacaaggg

SEQ ID NO: 400 - DNA, 1106 bp, Papaver somniferum
atgaaagaagctgatttgttgaacaaacaaatggatgctctgattgctttcaggattaaggttgagaatcctgatggaactaatcatcatttcgtaaattggtcggtagagatgaatgaacttgcttctggtgtcgctgcttctgctgctgctgtttcacttacgtcacctagagttgcttctccggccactgtcactatttcagcacttccttctccgaccgcaatgccgcatatggatgctattagtacggatgattctgttcgtggtggcagacgattcactgattcaactagtacggatgcagttagtagaccagcttcattagacgtccttaatcatgtgaccttcaacaatacacttgatacaccacgatcaaccataaagggaatgcttaaaaacaacgaaattacttatggaagaaagaacctacataaagttgaacagcaacttcaacaagctttcgttgagttgtattcagagcttcgacttttgaagagtttcagttttttgaatgtcttggcattttcaaagatcatgaagaagtacgacaagatctcttcaagaaacgcatcgaaatcttacttacacatggtggataactcctacattggcagttttgatggggttactaggcttatggagagagtggaagctacctttatcaagcacttcacaaatgcaaatcgtagcaaaggcataagaattttgagaccagcagcaaagagagaaaggcataggactacattttccttgggtttctttgctggatgcgggttagccctcttggcgtctcttatattgattgtacgtgctcgtaacatattggggatggatggaagtacgatatatatggaaaccttgtttcccctttatagcctatttggattcattgtccttcatatgctcatgtatgcaattaatgtctatgcttggagacgttatcgggtaaattatccatttatatttgggttcaaacaagggactgaattgggctacagggaagtcttcctcataagctcagccctagcaacacttgcgttggcaagcgtactcgcaaacttagatatggaaatggacaagaacaccaaagatttcaagaccct

SEQ ID NO: 401 - DNA, 354 bp, Papaver somniferum
atgcggataaatttcttaatccccctcgaccaccaaccagaagtaaaacaaacgtaccagcaattcctaatgtatggcccgttgcttctgattgggaaacatctcgtgcatttgttagattgcaaaaaaaaattctatgatgctacattgaaattttctggatcaacctatgtcacgtttaatttattcctcgatgaagtaatttgtattaatgacgtattgcaagaatgggttaagaatgataatgtattatttgctgacatggctggttggatggttcttaaatatgaaaagtattgggcagtggataaaatcaacaaaatgttatacattgttgtgttgcttgacacatga

SEQ ID NO: 402 - DNA, 573 bp, Papaver somniferum
atgacagaactgataaggaaccctgaagtcatgaagaaagcacaggaggatgtgcgaagaagcgttggagataaagaggtggtagaagaaagtgatcttcctaaactgaaatacttgaaactagtaactaaggaggcaatgagacaccaccctccagcaccatttctagttccacgagaaactacccaaaactgcacaatcaagggataccacgttccagcaaaaacaagggtgtttgttgctgcaaaagcaattggaatggacccaaaaatttgggaaaacccatctgcattccaaccagaaagattcttatataacgacatagatgtcaaaggacaagacttcgagttgataccctttggggttgggcggagggggtgccctagtgttaacttctcggtagtgctagtcgagctcacccaggcaaatttccttcatcgtgttaactggaaattgccctctgggatgaaaccagaggaagtagatatagacgaagcggatggtctcacaatgcacaagaagattcctctttgcctcctagctcaaaatgcaacggcatgcaagtttgcatag

SEQ ID NO: 403 - DNA, 519 bp, Papaver somniferum
atggttagaagctacttggtcttaccatcaccattaaatcctacacccaagtccaaaatagtcaacccactggattctcgtccaaccgccggagcattcacaaaagtgtcaaggaagccaacgaatcattcaaagttcacaggtaaatgtggtgtagcgaggtgcacagattgtcacattaacccggggaataagtcgaaagataaggccaaaggaactcaaaagcttaaatcatgtagtgctgctatgaatcagcggtcattggcttggagcgtcgtggatgctaacaatggaaatggtttgaattatgattcaaaatccgctacgggtattctgtgtgctatttctagcagtgaatattttgatgattatgatgatgatgacgacgatgacattgagtttgaagaatatgagagcaatgagcagttgacgtcactcacaggggcagaacagtttcaggagattgaatttgtgctggattgtcaagccgaagaagatgtaggttggtgtgttttgtga

SEQ ID NO: 404 - DNA, 2201 bp, Papaver somniferum
atggatcttgggaactctgaggtggaaagaaatcagcggttggagagtcttatcgcaagacgaagagctaggaagagcttcagaatgagtgaatcggagatgaatatgatggatttggactttaatgggcccccatttcagattgcaccaatttcaactgggaggcgtaacccatttgatcttcattatgattcttatatgggacctggcttacctccaatgcctggttcagctccttctgttatgctaccacgaagaaatccatttgatcttccttatgatgacccacttgaagaaagacctgatttagctggagacagctttggcgaagagttcatgacagctcatgagaaggatatgcactacaggaggtgtgagagcttcaacatgggagcttatttctttaaagatcacaggcaagaaaagaacaatgtcagtaggttcaaacctcgttttgtaactgaagaaatggcatcagaggggcgattttctagatttagcagacagatgagtgaagcaagtgagtctaagatgagttttgcttccgagactgaatcacattctacaattgcaaaccaggaagatattagtagtcttgttgaagaaaaaatatcatctcaccaggaagacattagtaatcttgttgaagagcagcaaatatcatctcacgaacgcgagctcagtccttcagttgaagacacacctggtcgaatgaagctagaaagtgagctctggaaagaagatcatttggattcagagagtgataaagaaggtaaggatgaggtcgatttaattaaggttgaggatgaaactgatgaatccaaaactacccatggaacgcaatcaagattctattccgaatttctcgctttagaagaacacctcacaagctatgttcatgtgaaccaagaagtgggcgaagagcagcatcacacaaggtccagctccctctcatcatccggtgttcgtgaaaaaatcaaggagaatagcgaagatgaagagagttctcatggaacacagtcaagttatgttcatgtcgatcaagatatgggtgaacatcaacaacacaccaggtcaaactcccactcatcttcagatatgcatgaaaagatcttcgacgtgaacgtagacgaagagttatcagccttggatccagcaagaggtgaagtccatgagcactcctccagcttcatgcaatcgacagtcattgattctgatcgggttgtaggagaagatgatagacatacagaggcaccagtttatgacttgagcccatcagcgtctaaaaggaacatgtctgacatgatgagttttgaagaaacagtgagttataaggataacatggttttcgcttctacttcttccgtgggttctgacatgcatgtggaggtaccggaacccgtaacagtggaagatatcactttactcgcagataaggaagcttcagtgcagattggtagccctagaaaattgatgaccccggggtatgaaaaatcatgggaaccctcagcagagctctgcgtaatcgacgagaatgaagctgaaaaagagggcttaccgtgtgaagaggcaagttttccttcatcgagtttccatccaaagatagctgctgaagttctccaatctgataaggatgaaaaggttgataccttggacttaccatattcagatgagatgtcatctcgagatatagctttgtctgagttaaaggatcaactggtccagccatcatccagtgtccatcaagaaaattctgagggaatatctatcctttctgatatttcggcaatggaagacggtgccattcaggaagttggtgggccactggtcgatgagcaccaagaagacgatgtctcaaacctccctaccttcctttctactcctacttctcccccgactgagtttgttcaggaagttggtgggccactggtcggtgagcaccaggaagatgatgtcttaaacctccctaccttcctttctgctcctacttctcccccgtctgagtttatcggttatcaacaacatcaaatggttttcgaagatgactcacacgatggaactcaatatgaaagtaaatttgatttcaatcaagaatcaatcgggtatcatgaagcaaacgaagaatttgatgatgaggagccggccggaattgaagagatcgacgaagaatttctgaccgaacttgatgcagttggtgactt

SEQ ID NO: 405 - DNA, 483 bp, Papaver somniferum
cgacatcttgcagaaaccgatctggagcttccagttattgaagcaagattcattgaagatgttgatgctgtcttgaagcaactccacaagggagataactcggagacatttatagctaatgaaccagaattgaagggatctgcagtaccatcagccgagtcttttgaccatatgcttgatgacccactgctgctggaaacaaaagatatgcagggtgagttgacactgcatacacaggagcaacatctgacagaaaccgacttggagcttccagttattgaagcaagatctattgaagatgttgatgctgtcttgaagcagctccgcggaggagataattcggaggcattgattcttaataaaccagtgtcggaggaatctacagtagcatgcgccaaatcttctgaccatgggcttgatgagccacagttgatggaaacagaagatgggcagggtgagttgacacatctaaaactagagtga

SEQ ID NO: 406 - DNA, 558 bp, Papaver somniferum
atgctgcttcgtcttataaacaacgtagtttgtcgagttgcttttgggttaaagtacgaagaggatggcaagaataagatctacctgacgcttcaagaaacagaaaacttgcttgctggatttagtactgcagatttgttcccgtggatgagttggattcacaagttcgatggatcagacaagaaactagacaagaactttgggcgtatggatgaattctatgataaagtaatcgatgaacatatttgtcgatgttcattgaaaactggtgttgaggaggactttgtcgacgttctactacgagtgcaaaaagaccctagtcagggaattagcctcactagagataatatcaaaggaattctcatggacacatttgttgctggaactgatacttctgctgcgacactggtttggactatggcggagctaatcaggaacccaacaaccatgaagagagcacaagatgaggttagatcggtaattggaattaaggagatggtaaaagaaagtgatcttcataaactaagttacacgaagttagtgattaaggaagcattc

SEQ ID NO: 407 - DNA, 1767 bp, Papaver somniferum; identical to SEQ ID NO: 58

SEQ ID NO: 408 - DNA, 525 bp, Papaver somniferum; identical to SEQ ID NO: 349

SEQ ID NO: 409 - DNA, 357 bp, Papaver somniferum; identical to SEQ ID NO: 350

SEQ ID NO: 410 - DNA, 243 bp, Papaver somniferum
atggagcttttaattctatcaacacttgaatggaagatgaatccagcaactcatatttcattgcttgatcacattattagaagatttggattccaagttttttcattaccttccatcagtttagttgcggcagtaatgctaaatgttattgatgaggttgaaactgaaaacccaatggaatatcaacaccaactcatgactgctcttaaactcacaaaggaggatgtaaatgagtgttattag

SEQ ID NO: 411 - DNA, 684 bp, Papaver somniferum; identical to SEQ ID NO: 354

SEQ ID NO: 412 - DNA, 711 bp, Papaver somniferum
atggcacattcactaaccgagcatgtggaggaaggtagttgcgatcgaacacttatcctgtcaaatgctttaatccacatgtatgcaaaatgtgcaagcatcgaccaagcattgctagaattcagtaaaatgcatgagcgggatgttatcacatatggtgctctaatcacagctcttgctgatcatggaaggcctcaagaagctctggagcttttctcaaagatgcagaaaaaaggaatacaaccgaataaagttactttcttaggagtctttaatgcgtgtagctatgctggactagtggaacaagggtgcaagtatttcaagctaatgacaacaacttgcatgattgaaccatcaacagaacatatttcttgcatggttgaccttcttggccgagccgggaaactcaatgaagcttacaagcttatattagagaatacaggtgcatcaagagatgctggagcttggggtgctttattaggtgcttgtgctgtccatggtaatgttgagctgggtgaaatatcagctcagcgtttgttcgaaatcgaacctgataattcagggaattatgtgcttttggcaaatatttatgcttcagtgcgtagatgggatgacgctgctcgagttagaaccacgctgagtgaaagaaggatgagcaaaacagtcggatatagctggattaaagaagaaaatggagcacgaacattctga

SEQ ID NO: 413 - DNA, 3366 bp, Papaver somniferum
atgtataccggtgccacatcgcatctcactgcggattcaggtactttgaatactgtttttaatactagtaatattcattccatcttaattggcaatggtcacagtattccagtcactgcctctggtaccaagttcatagatattccgtcccgcaccctaaagctcaaagatactcttgttgctcccgacataatcaaaaacttggtttctgttcgtaaattcaccactgataatcatgtgtctgttgaatttgacccgtctggtttttctgtgaaggatttgaattcgaggaagattctccttcgatgtaacagttccggggagctttatcctattactacttctgccgtatcaccttcaacatcgtctctgtctcatcctatatcccttgccgtgtgctctcatgacatttggcacagccgtcttggccacccagggaaagctatcttagataatttacgtgcaaactcttcaattcaatgtaataaaaatcagtctaccaaactttgtcattcttgtcaagttagtaaacatgttcgtctgccattttttgaatcaaattctgttacttttgctccttttgatatcattcatagcgacttatggacctcaccgttgcatgttgagactggttttaattactatcttatattgttagatgacttcacaaattatctatggatctatcctctcaaattaaaatctcaagtttataccaagttcttggaatttcgttctttcgttaaaactcagtttgaacgtgaaatcaaatattttcagtgtgacatgggtcgtgaattcgacaactcatcgtttcatgattttactcacaaaaatgggttagttttccgtttctcatgccctcatacctcctctcaaaacggcaaagctgagcgaatgattcgtcgtgtcaatgacatcactcgcacgcttatgtctcatgcatctgtccctcccaaatattgggccgactccctacatatggccgtctacctccacaccattcttccttccaaaatcctaaatttctcttctccggtgtccattctctatcaacgtcaaccaacgtactctcatattcgtacttttggttgcctttgctttcccaatctttccgctaccactactcataagctttctcctcgttccactaagtgtgtttttcttggttttccaactcatcaccgtggctatcgatgtctcgacttagccactaacaaaatcatcttatctcgtcatgtgacgtttcatgaaaacgtgtttccattcaagaataatgtttctactccatcagactgtcaagactctccctccacaccatcctccactctccttcccattcgtttccgttacccaacatctcctcatccccctgtccagccaccttccgccactacgtcagttccttcttccactacacagcagcgcccagacgttgctccaccatcttccgccactgcacatacaccgtctcctgcaatacatccctacacacctcctcatcgtcgttccattacagcacctcacctccacattcccccacagcagcagtcagctcccacagctcctgacagcaacatttcagtgcgtcctgtcactgcaacagagcctgacagcaacacttcagcacctgcaacagcgcctgacagcaacacttcagcgcctgactgcaccatccaggcggtcacgcctccatcttccgctcagcctggcacttcagccaactcctctcgccatgttactcgtgcctctcgtggaatcttccgtcccattcaccgattgaatctcaatgttcagacacaacagcatatctccaatctgccaaaatctcacctttatgctcttagggatcccaactggaccaaggccatgctagatgggtttattgctatgttaaaaactaacacttgggacctagtaccacgacctattggatctcatgttattcgttccatgtggttatttcgtcacaagtttaatgcagatggtacattgcagcgatacaaagcccgtcttgttgccaatggtaaatctcaacaggttggggttgattgttttgagactttcagtctggttgttaagcctgccaccattcgtaccgttctcagcattgccacatcaagatcttggccgattcaccaattggacgtaaagaatgctttcctacatggggacttgtctgagacagtttatatgcatcaacctccgggatttgttgaccccgctcgacctgattatgtttgtcgtcttcgtcgttctctttatggcctcaaacagacgcctcgggcgtggttccagaggtttgcgactttcatcacaggttgtggttttcggggtagtgtttgtgatccatctctctttatttaccggtccggcagggaaactgcatacttattactatatgttgatgatatcatactcactgcctctactgatgctctactagcccgttttatcgacctgatgaaactggaattttctatgactgatcttggcccgttacatcattttttgggtattactgcttctcgttcttcctcagggttgtttttatctcagtcactctacacaaaggacatcattgctcgtgcatccatgacgaactgcaatccagtagcaacaccggtcgacacgcactctaagctcagtgctacttctggaccagcactttcggatcctactttataccgtagtctggccggagcgttacaatacctcactttcactcgaccggatatatcttatgcggttcagcaggtatgtttatttatgcatgaccctagggagccacacatgcaagccattaagcgcattattcgataccttcagggcactattgatcatggtttgtctctctcggtttcgaatatctctggtctcaccgcctattctgatgctgattgggcgggctgtcctgactcacgccgatcaacatctggttactgcatttttcttggagacaatcttgtctcttgttcttccaaacgtcaagcaacggtgtcccgctccagcgctgaagcagaatacaggggtgtcgctaatgctgtggctgaaacgacctggctacgaaatttacttcttgagttacatatgccattacagcgggccactctggttgattgtgacaatgtgagtgctgtctacatgtctggtgatccggtccaacatcaacgcacaaaacatgtggagattgacattcattttgttcgtgaacgggttcgtattggtgatattcgtgtcttgcacatcccttccgaacatcaatatgctgatatcttcactaagggtcttccaagacaattgtttattaattttcgttctagtcttagcgtttgttcctctcccgctcagactaagggggtgtaa

SEQ ID NO: 414 - DNA, 528 bp, Papaver somniferum
atggagcccagaaaggttctgattttagtggtgttaggtttatttggtaacatttcgtttactgcttcacaattatttccgccgccgattcagagtttcattcctatagaattatctccgccaccagctcagaatttagctcctcctcaattatcaccaccagcatttcagaatctcgcaccaccgttgacaccacctccgcctcctccagcaccgtttcctcccccccctcctttcgtgccacctccacctcctcaagctcaatctccaccaccgccaccaccaccaccagctcctcagcattctcctcctcctccgccaccgcattggaggagaccgccaccaccttggggtaatcctaattatgctggacgtaggaatgagtggaggaaatcaggtaaggagatgaattttgggaagaaaatcgggtatttatttctgtgtgttggtggggctctccaaattggtgttatttcttttttgggattcaagagatggaaaatttcgaagattaaagatcgaggatga

SEQ ID NO: 415 - DNA, 657 bp, Papaver somniferum
atggcttcgtcaatttctaaaacccgaaaccttcaaacatacttctcaagtgctaatagaatacctaaacttactcctctattctccacttctaatcgggttctttccacacttgcagaatctccaattgattcttcgtttcaagctcaagagaaaaaatcatggtcgagatatcttcttttccttcctggtgctatcacttttggtcttggaacttggcaaatttttcgaagacaagacaaggttgagatgctcgactataggaggaataggttgggactggatcctgttgtgtggaacaacatttcctctttttcttcaagggaagattcagggtctctggaatttaggagagtgatgtgcgaaggtatttttgatgagagtaagtcaatttatgttggacctcgttccaggagtatttcagaagtgacagaaaatggctactacgtcattacacctctagttccaaactcaagtgaccctaagagtgtgcagtcaccagttctggttaacagaggatgggatccacgcagctggagagagaagcatcaaaaggattctcaaaatgttgaaacagttttgaatataaaaattgtcgatgatggagaaactgaaggaagctctcgatggaagtttggtctaagaagcatggtttaa

SEQ ID NO: 416 - DNA, 894 bp, Papaver somniferum
atggatattagcggggaacaacatcttgatgtgaaacatgatgtaatcaagaataggatagatgccaatggaaatataattgagacgaagaaggatggcgttggtgtgcataagattgaaaagccgttgcagaaacatggtggcaggcttgaacacaatgagacatattgtggttcatgttatggcgcagaaacaacggatgcagattgttgtaactcgtgtgaagaagttcgtgaagcatataggaagaaaggttgggggatgtcaaatccagatgagattgaccagtgcaaaagagaaggtttcctccaaaagattaaagatgaagaaggcgaaggatgcaatatttatggattcttagaggtgaataaggtggctggaaattttcattttgcgcctgggaagagtttccagcagtcaaatgttcatgtacacgatgtgacggcttttcagaaggattcctttaatataagtcacaaaatcaataaattatcttttggagaatctttccctggtgttgtgaatccgcttgatcgggtacagtggacgcaaaagactcctactgggatgtttcaatattttgtcaaggttgttcctacggtttacacagacataaacaatcacactatccaatcaaatcagttttctgtaacagagcatttcagacacgcaatagttggtcaacctcattcagtaccgggtgtattcttcttttacgacttatctccaatcaaggttactttcacggagcaacatgtgtcattcttacattttctaacaaatatttgtgcaatagttggaggtatgttcacagtttctggtatattagattcgttcatatatcatggtcagaaagtgataagaaagaaaatggaaataggaaagtttagttag

SEQ ID NO: 417 - DNA, 795 bp, Papaver somniferum; identical to SEQ ID NO: 55

SEQ ID NO: 418 - DNA, 285 bp, Papaver somniferum
atgacttcagaatcaccgaattcatcacgtaaagttgtagttcatcttagggcaactggtgatgctccaatacttaaacaagcgaagttcaagatagcaggaactgataagtttgcgaaagtaattgcttttcttcgtagacaacttcaccgtgatacgctatttgtgtatgtaaatagtgctttctcgcctaaccctgatgaattagtgaatgacctttacaataattttgggtttgatggaaaactggtggtgaactatgcttgctcaatggcctggggctaa

SEQ ID NO: 419 - DNA, 327 bp, Papaver somniferum; identical to SEQ ID NO: 338

SEQ ID NO: 420 - DNA, 255 bp, Papaver somniferum
atgaatgatggtgcactttacatatccaaattgcagtttctggttcagagattcaatatgactaaactccctttcacaaaaatgcgtgcttgttgtcacgccaatgtaacaaagataatacaagtgaagtcattcattataatgctaaaccagaatatcatgtgtcacgcccaaataattgattatctaaatttactggcaagcaaatacagctgtcacatccatcattgtggaacaacagctatgattccataa

SEQ ID NO: 421 - DNA, 798 bp, Papaver somniferum; identical to SEQ ID NO: 54

SEQ ID NO: 422 - DNA, 519 bp, Papaver somniferum
agtgttaaagcaataaaattccaagcaccgaaaatacgaaaagctttgattcacttgataaagacatccaaaaataatgaagaaaagtgtattgctcagggtatacttaagaatcacatgaagaattttgaattttttcttggcatggttatttggtatgaccttttatcggtcgtcaactccgttagcaaatcactacaagcaaaagatatgcatatgggagatgctattgaacatataaaaatgcttgtttcatttttcaaagagtacagagacaatggcttccaagctgcactagttgaagctaaacaaattgctgttgacatgggtattagtcctaaatttcaggaacaacgtgttagaaagcggaagaagcatttcgatgatgatgctagcgaggagacagttcctgactcagatattgatgggagagatctgtacactgaattaaagattatgaaaaggacactgccggccgagataaagaaaccaattgagaaagaagtttctccaaactga

SEQ ID NO: 423 - DNA, 663 bp, Papaver somniferum
atgcctccactcaaaagaaagcaatcatcaggatgtcaaaatagaaaaatatctaagaagaaagaagagttcaaaaaatctcttgttgggtctcttgaaaaatatgtggtaagaacaagtgaaaccattgtggtagataatgtgaatgttgcaattactgatacgggggggaacgttaatcgtacagttgagagcaatacttgtgaaaatgttgatcaaaatttaaatgagataaacagagatggtaatgatgcacatgttgccggaaatgttgatactgtggcaggtgggggagatgtaaatgaattaaatgagaataataacagtgtgaatgttaatgaagaggtaaatgacatggatggttgtactgcgactgagtttaacatggaagaaccgaatcaagatatttttgatccaaagaattggggtaaaatcgatcaaaaattgattgattttttagttgagaacggtccaagaagggttgaagattatgactttccttatgataaatttggtaaacgtttttctagaaagcattatacccgtaagatggcaaacagggagaagcaagataggagatggcttgtatattcagtttctttagacaaagtattttgtttctgttgcaagttgttcaaaaaagatgattcaacacaattagct

SEQ ID NO: 424 - DNA, 1308 bp, Papaver somniferum; identical to SEQ ID NO: 357

SEQ ID NO: 425 - DNA, 354 bp, Papaver somniferum
atggaaggggaaacatattcagtctatggaaatggtgtgaatcataaagttagacaaagttttcacaagaatttcattcaagttcagagtttattagatcaaaacaggttacttattaatgagattaatcgaaaccatgagtctaatatacctcatgatctcaataggaatgtgggtttgattagagaattgaataataatattagaagagttgtgcttctttatgcagatctttcaagctcattggtttcttatgaaggtggtggtggtgattttagtggtggtggtggtcgtagtggtggtttgtttgagagattcctcaatcataatggcaagaagagaaaaactccatga

SEQ ID NO: 426 - DNA, 2004 bp, Papaver somniferum
atgatgagcattttttcagacatgatagatagttttctcgagatctttatggatgatttctctgtgtttggttcctcttttgacgaatgtttggaccatctagtccttgtgctatcaagatgtaagcaaaagaatctgattttaaactgggaaaaatgccacttcatggtgaactccggcatagttctaggacacatcgtatcggaaaaaagaattgaagtagataaagctaaagtcgacctcattcagcaattacctcaaccccactctgtgaaggggattcgatcatttttaggtcacgctgggttctaccggcgattcatcaaaaactttagccaaatctcaagacccttgtgtaacctacttgccaaagatgttgtctttaacttcgatgcttcttgtgtgaaggcatgggaagaactcaagactctcctcaccaccgctcctatagtccgaccaccagattggaaactgccgttcgagctcatgtgtgatgcctctgattatgccgttggcgctgttctagggcaacgtgttgatagactaccatatgtgatatactatgctagtaaaactcttaatgatgctcaactcaactattcgactaccgagaaggagttacttgccgtggttttcgcattagacaagtttagatcttatctgatagggtctaagatcatcatatacacagaccatgcggctttgaagtatcttctttccaagaaggatgctaaagctcgccttattcgatggatactcttattacaggaattcgatcttgaaatccgtgataagaaaggttgtgagaatgtggttgctgatcatttgtctagattaactttagagtctattgatgaatttgagatgattagagaatcattcccagatgaacagctgatgtctatctcagaccttccttggtttgctgatattgttaactacctcgctacaggtaggatgccctcacgttggtcgagacaagaccgctctaaattcctggctgaagttaaacatttcctttgggatgacccatatttgtttaagtactgcccagaccaaatcattaggaaatgtgtccccaacaccgaacagaaaaatgtgatatctttttgtcatgaccaagcatgtggaggccatttcagtgccaagaaaaccgctgcaaagatcttgcaatgtggattctattggccatcattgttcaaagattgccatgattattgtgttgcttgtgaacgctgtcaaaagctaggaagcatttcgaggagaaacatgatgccattgaaccccattttgattgtggagatttttgatgtttgggggatcgacttcatgggtccattccctatttctgacggtagattgtacatcctagtcgcagttgattacgtttctaagtgggtagaagccatagcaaccagaacaaacgaccacaaggtggtactttcatttctaaaggaaaacatatttgcacgttttggtacccctagagctatcatcagtgacggcggttcacattttcgtaacaagtactttgagtctttagtacgcaagtatggcataactcacaaggttgctactccgtaccaccctcagactagtggacaagtagaagtttctaatagggaaattaagcgcattctggagaagacggttaacccgtctaggaaagattggtcattaagattgaatgatgctttgtgggcctatagaacagcttataagacaccaattggcatgtccccctatcgtctagtgtatggaaagccgtgccatctacctgtggaattagaacatcgtgcctactgggcaatcaaggagctaaacttttctctggacgaagctggaattcaaaggaaacttcaactcaacgagttggaagaattgaggaatgaggcttatgacagtgccaagctgtacaagcagaagatgaagatgtttcatgacaagcgtattctgcgcaaatccttcactcctggtcagaaagtcttgctgtatgactcctga

SEQ ID NO: 427 - DNA, 789 bp, Papaver somniferum
atgtctgaatttgaaagagtgaagatgaaagacactgatactattgatagatttgcaggaaagctatcagagatagcctcaaaagctgcgtcacttggacaatccattgatgaagataaactggtaaagaagtttctcaatagtttaccaagatccaagtatattcatatcatagcttctctcgaacaagtcttagatttaaagaagactagctatgaagatataattggaagattgaaagcatatgaagagagaatccttgatgaagaaaacaatggagaaactcaaggaaaactcttgtacacaaactcttaccaacaaaactctgcgacaagaggaagaggtcgtggaagaggtggtagagtaaacagaggccgaggaaggggaggaaggtttaactcacaagatagaacaacaagtcagaatgatcaaaaccaagggaaagaaaagaaggatagatcaaacattatttgttacagatgtgataaaccaggacacttctcctctgtatgccctgaaagaattcgaaagatggaagaagcaaacaagaatgaaacaagggaagccgatactgctcttttcatgcacgaagtagtattcttaaacgaagagaaattaataccaaaaaactatgaaacaaaggatagtgaagaaggagtatggtatttagataatggagccagcaatcacatgactggtaagagacactacttttctgaactcaatgagaaaatcaaaggacaagtgaagtttggggatggatcttctgtagaaattgaagggaaatga

SEQ ID NO: 428 - DNA, 738 bp, Papaver somniferum
atgcgacaagattatctaacagttcatgacccaagtggaagacttttagttagagtctcacgctcacagaatagactctacaagataagtctcatgattggaaggccattctgtctgaatatgagactgcaagatcagacatggaagtggcatgcaagattaggacacataagttccagaaccttaaaaactatgtctcaaaacaagatggttcgagggctaccacaaaaaaacggagtggtggagaggagaaaaaggactctaatggagatgacaagaagttctttaaaggatatgcaggtacctaagtatctatggggagaagttgtacgacactccacatacctaataaacaggatacctacgaaagctctgaaagacatgactccatatgaaattttgcgaaagaaaaaaccaaacatagttcatttaagagtgtttggttgcaaagcatacgcaagagttgattctgcaactcttaagaaactggatgatcgatctcagactcttgtgcatctaggaattgagcctggatccaaatcttacagattattcaatccaacaacgaaaagagtaatagtgagtcgagatgtggtattcgatgaaaaagcaaactggaactggaaagaaactaatgatggaccaagtagggatccaggaatgtttcacatgagatggggtcaagtaattgaaacaatgatcatcaataccaatggaaacaatgatgttaatcaataa

SEQ ID NO: 429 - DNA, 561 bp, Papaver somniferum
atgtctatcaaattcaagttcagaagctcagtgaatttcgattctattgatttagaagattcaccatcagtatcagtcagagatcttaaatcaagaataattaatcaaagtaaattgaagatttgtcaagattttgatcttgttctatctaatgccattactggacaagagtttgaagatgaggaatttcttgttgaaagcggttcaagtgttataattaagagagtaccagttgatagagatgctaattctgttcggccagcggttgagaatatggcaaaaaaacactatccttctgttcatactaatgaaccgactcttccggcagtgtgtggcaagaacgttgaagtcgaaaacttcgatgactttgggattgatctgtatcctgctccagagacacctttgttggactcggacctcgatgatgataaagtcaattgtaccagcagtgtacatgcagataaggaaattcctagatgctctggttctggtccatcaggagtgaaacatcaaaatattgaaaaaagtgatcctagtgaaggtattccgaaagagtggtag

SEQ ID NO: 430 - DNA, 222 bp, Papaver somniferum
atgaattataacgctctgtttcaaatgtacgtatacagtttcagtagttcattgtacattactgtagccatccttgtgcaagtgactgtcaaccaacaattgctggccatccttaggttggttgacagtgattgctcaaggatggccggctgttggtgcttcagagatttttgttgcagcttcatgaagtgtcaaacctttctccttggtgtcaatcaataa

SEQ ID NO: 431 - DNA, 768 bp, Papaver somniferum
atggcgatgatgaatcggatttcgtcaagattctcaagatgtttgacatcttcaataactactcttcttcattttgattcctcctcctcttcattaggaagacactcctataacacttcttctctgcaaagatatgcccaagagaagccaaagcaaatgattccaggaaataacatgaaatggggttcacttggtcctcgtagagattattcgaatttcgcgtctgggttcacgcctttgcaacaaaaaccattgagttcaattattgacattgagagagccaagaatttctcaccagaagatcttgctgacatttgggatgattatcacttggggagaggtcatattggcataacgatgaaggcgaaattgtatcacctaatgaagcaaagagcagttacttgtcggcattttgtcattccattatggaaaggaactggttatgtaacaatgttcgttcaagtgcagatgccacacattattttcactggtctggaagattacaaggcaagaggtacccaagcagcaccctatttcacagctacttatttcacagaatttgcggagaccaaggatatggtgctcgtccgtggggatattgtattcaccagcaagctcactgacacggaggctcaatggcttcttgaggcaactcaagctttctatctcaatgatgccaggtacaaactggttgaacaatttaacaagcagactcacgattttgagttcaaggatgtgttgaaggcactggatatgccagtgggttga

SEQ ID NO: 432 - DNA, 1902 bp, Papaver somniferum
atgattaatggtagccctgaaggttttttcagtatcacaagaggtcttcgtcaaggtgatcctctttcccctttgatttttgttcttattgaagatgttttgagccgcaatctctcaaagttatttgctgctagaagtatgcatcacatggtgagtaagaaaggtgtggccccaacttttttactctttgcggatgatattcttattttctgtaaaggcaatcttcatagtctgcagaatttgaaggagatgcttggcatgtatcaacgtgcttccgggcagtatgttagttatgccaaaagcaaattctattttggtggagatagacattctcgtgttgttgctattgcaaactttatgggcatggagagggcgctattcccggataagtatttgggaatccaactgaagcctggtattgtgcgtcatattcatgttcatcaggttatggaaaagattatggataagctggctggttggaagggtaagctcttgtcttttcaagcccggttagttttgatcaaatcagtaatctctagttatttgcttcattccatggctgtgtataaatggccttgcacagccatcaagacggtggagagggccatccgcaattttttgtggtctggtgatgctgagaaacgcaaacatttcacggtcctttatgataatttatgtcattctagggttgaaggtgggcttgggctaaagaaattgaatgatgttaatagggccatgcttatgaagttgtgggtctcgattcgtgactctaataagacttgggccagatttttgaaggcaaaatatttcaaggttaatggaaacttgattgattataagttgggttcttcggtttttccaggtatcagattggttcataactttgtgcaacgccatacacgctcaattataggtaacggtgctaatacttccttattctttgataattggtgtgctgatttttcaattgcaagccgccttggcattacaacaaaggggcctaatgattttaaggccaaagttagtgatattattgttgatggctcttgggttattcctccaaagactaaagatttgatgattcgttgcaatattgatgttgataatttgcctcttattggtggtggtgatgattataagatttgggacttggacagtaagggtgctttctctgtcaaatccgacaaggctgccattcgtgggcctattgaagtgtcgccaactgcatctctattctctagaagtgttgtgcatcctactttgagtgttcaatactggaagttatttcataaacaatgttgtgcttccgatgataatgttatgaagaagacaggtagggagatgccttctatgtgtcgtttatgcagggacgattgcaaggatgttagccatatcacttggcattgcaaacttgctaaaaggatttggaagtgggcagcggctatttttaagattcaaccaaatgaggaccttgtggcttcttacaaggtggaaaagggacggagtagaatgataaaagacctttggcttgttgctaacctagcaatagtcacggagttatggaagttgcgtaacaaagcttattttgagaacatgcgggttcgttggctgaagtttaaaggaagagttcatcaggtaattcgtgataactctattagaatgaagggccatatgcataatactttggatgatttgcgtattgttaatttctttagagtgaagcatagatcttgcgatcactctgatccaattgaatttacttggactccaccaaatcctggtgaaattatgatctgttgtgatggtgcatcacttggtaacccgggacaggctggttctggtgttgtcttccgtgattctaactcggtagtcttgggagttttgtgcgttggtctgggctga

SEQ ID NO: 433 - DNA, 1245 bp, Papaver somniferum
atggatgaattatttgaagaactagtaggctatttgatgcaaaaggaagaagcaaatattcaagagaatacgaatcatgaggatcacaattctattcccggtggtattgatgacgataatatgatgccagtggcgatgatggacagtttcaacattaatgttgattatgagcgagatggagattgctataatccccatatggatctacaatgtaatgttgatgattacgattatcagttgggtgcattattatatgatgaatgcttagctgatcttccattattggatgccaatatcaccggtaattttcaagaaggttgtgtttccggtaatccatccgatgatagaatccagtgtgaccgtctattaccggatgtcactgatacttctctagaaaactgtgatatcgatcagtacttcaatctgatggagacttcaacaatgcagcagaaaacggatggagatgtttgttgtgatcctcatcaaccccaatcaccatcaccatctatacctgatcatcaaccacaacaagtagaggatattggtgatgatgttgatacatccagtaaaaatttgaagtcagaacgtaatagacgcaagagattgaaccaacagtatttgacgttgagatccattgtcccaaacattaccaagatggataaaagaaccgttcttgttgatgctctggcttatctacaagatatacttcaccagatacaaattgaaattgaaaatcagaacaaagtaatctcatcacttaattcttccttgggaaatgaggaaacaatcaatctgcctctccgtcatcacaatgaagatgtagtatcggcagtagagaagaacgctgtagatgttagtggcaatgatggccaagtccaaccattattccacaccttactagttgaaccagtagtaccaccaggtccaccaccatttgaacgtcgggcaatctttccagcaataatgcagatggaagttgagaagctagacgaggagagatatgtgttgaggattgtgttcaacaaagcatcgggaacaatgggtctagtacaaagatcagtagaaatgttaaaaggatttgaatccataaacgttgccctttctgcatacgatcaacatcacgtgcaatcttccaactttctacgcgtaagttattcattgtttatttcaagtttcaagggaaagcattgtaattattcttctcctttcacaaggtgggctactcctactccttttggtatatga

SEQ ID NO: 434 - DNA, 1470 bp, Papaver somniferum
atgggtttcgctagctgtctagggtgggacaacggtgttatgttggcaccaatgggagccgatatcgccggaccaaaacttgttgcagctgtggccaatgccggaggccttggtttattggctagcccagttaatatgtatgatgcgactctgaagatgataaaagatacgaagaagcttacaagtaagccattcggagcaggtattttgctgggatttgatcaatccagcactatcaaggccatttttgacgaaaagctcgcatgcatgcaagtctactggggagactttagcaaagagatggtggacgaagctcataaaaatggagttaaagtcatacaccagcttggttcagttgccgatgcagagaaagcaattgctgcaggtgttgattgtatcatggcacagggtccagaagccggtgggcatgtcattggacatgttagtgtgattgctttggttcctaggattgtggatgtaatcggtgacaggaatgtcacagttgttgctaccggatccatcgcagacgctcgtggttttgtggctgcccttgcacttggagctaaaggaatctgtatggggacgaggtttatagctgccgaagaatcatatgcaaatgactactacaagcagcaattgcttcattacaccgaagccgacacagattacacagacctatacagtcgtgcaacctggagagcaccaactcgtgttcttaatacacctttccatcaaaaatggaaacctgtaccacaagatgtctcaaacaatgaggatcaaccgatcgttggttactcgatcattcatggaggggaaacgattcttcgtcggtttgcaggacaagtagcaaaccagaccacggctggggaacttgaaaacatggtcatgtatggaggacagggagtcggacttgtgacaagtattcttcctgctggtgacatcgttaagagtgtcgttgagggtgctgaaaagatcattaaggaacttggtagcagaacacaggtaaaacccgtgaaggccgtcgttcttctgaaaagcactgaaggtgtctctggcaccctttactttacccaagcaggagatgaaccaactaaaataattggaactatctctggtctgaaagctggacttcatggtttccacatacatgcacttggtgacacaacaaacggttgtacgtctactggaccacattttaatcctgctggcaaagaccacggtgctcccggggatgaaacccgtcatgctggtgaccttggaaatcttactgccggtgcagatggtaaagttgaagtgaacatttccgacaaacagattcctctcagtggaccaaattccataattggaagggctgtagttgtacatgctgaccctgatgatcttggaaagggtggccatgaactcagcaagaccactggtaatgctggtgccagaatcgcttgtggtattatcggccttcaggctaattga

SEQ ID NO: 435 - DNA, 924 bp, Papaver somniferum
atggctcaattaccaccaaaagttccaaacatgacacaaaattggccaaattttcatcatcaaaaaatgccatcattgggtaatttgatgccaacagcagcagcaaatggtagtactcaacaacagcaacaacaacattcaccgtcatgggtagatgagtttcttgatttttcatcaacaaaaagaaatgcacatagaagatctgcaagtgattcaataacatttcttgaagcgccatttgtggaagaatgtagagctaattcagctggtttaaggcctggtaataatgagtttgatagattggatgatgaacaacttatgtccatgttttcagatgatatttcaaccactatacctcaaaatctatcttcatcaaacccttctacaccttctgatcataatagtattaatgacgataaacctacaccgtctgatcaacaacaacaacttaagaatgaatcaggagaagtacagagttcatgtcaatcagaccaagttcctccacctaattccaatggtgattcaatcatcgatcctaaaagggttaagagaattttggctaaccgacaatcggcacaacgatcacgagtgaggaaactacaatacatatccgagctcgaaagaagcgtgacatcgttgcagacggaagtatcagcattgtcacctcgagttgcatttctagaccatcaacgccttgttctaaatgttgataatagtgctcttaagcaaagaattgcggctctagcacaggataagattttcaaagatgctcatcaggaagcattgaagaaggaaatagagagattaagacaagtttatcatcaacaaaatctaaagaaaatgaacaacagcaacaacaattcatcaactgacaatcagaaccaaaacggtactgatcaagaggatcagcaaccaatcaactga

SEQ ID NO: 436 - DNA, 2001 bp, Papaver somniferum
atggagctgccatcaatattgtatctaaagttctttgaaacagctcctgatgggaagagtcgaaattgcaagttctgcaagcaaagctatcctattacaacggctttagggaatttgggaaggcatttgaaatattaccatccgggatatgataagatggatgatgcaatctttagtttatcgccacaacccatcacaattgtatcgtctctgggtgatgtcaacaccagaccatctccgcagcccatcacagctggaagggaaaccgctgataataatggtggtgctgcccccaggtcgtcgctgtggcccatggcaagtgtaaccaagatggatgataagatgagtaatgccttcccaagctcatcgcagctgtccatcccaactgtgtcgcagggcgctgatacgatgggtgatgccatatcccgcccatctccgcagtcaataacaactgcatcaaacagggatgtggaacctaaaaacaccacggaaatagttgaggcggcatcattgtatctcaagttctttgaaacagctcctgacgggaagagtcgaagttgcaaattctgtaaccaaagctatcctgtaccaacagcctatgggaatttgggaaggcatttaaaataccggcatcctgaatatgagaagatgggtgaagtcctctccagcccatccccgcaacgcattgcaactgtatcagagagggctgataagatgggtaatgctatccccatcccatcgccacagcccatcgcaactgtgacggaaacagctgcgaagaagcctgaagccgtccccaggccgtcgctgcagcctatcacaactgtggccaagacggctgataagggaaatgtaactcctgcagcaaaaccaacggaaaattcagtgacttcgttctttaaaatatctcttgatgggatgagtcaaagttgcaaactttgcaaccttagctattctattgcaacggcgattgggaatttgcaaaggcatctgaagcatcgtcatcctgatgaatatgataagatgggtgatatcgtctcaaactcatcgacacagcttatcacaactgcatcgacgagtaatactgtggatcttgacaatctgaactggttactacttaggtggctcatgggaggttcttttcctccctctgcgttgcaagataagtggctatcaaactccttcaagtttgtcaatcccatggtcaaattatggtcgaatgaaaggcttcaagctatcattcgggaggtattcaaaagcacgcgggaagatgtaaaggcttcattagaacttgttaactctaaaatctcacttacccttgagttctggacttcctacgaacaaatcttctacatgagcgtcactggccactggattgatgagagctggtctctgcataaggttcttcttgacatttctcgcataccttattcatgctctggtgctgatatctaccgcgctattgtgaaagtcctcaagatttacaacattggaaacaaaattctctcctgcacccatgataacagtcagaagaccatacatgcttgccacaaactaaaagcgtatttggatggtcagaattcaatggccttctgctatatcccatgtgctgctagaacactaaacctaatcatagaggacggactgagaaatgcaaaacctgtgatatctaaaatacgggaattcgtactcgagttgaacatatctccagcaatatcatctgatttcaagcaaacagcatcagcatatcaagaaggttcatgggaattccctattgatatttctactcgatggagtggcagttatgcaatgctagatattgcgtgcaaggcctctaaatccatggatgctgttataagaaagcatgcagatactctggatggtagttacatgctcctgatgagctcagtcagtatttgtccgaggctccatctcccatcaccactgatatcttggactggtggaaacgaaacagttccaagtacccacgcttatctgtaa

SEQ ID NO: 437 - DNA, 678 bp, Papaver somniferum; identical to SEQ ID NO: 231

SEQ ID NO: 438 - DNA, 2361 bp, Papaver somniferum
atggatccttcaattaagaaagaaaatgggagtaatggaggagtagaagtagttttaacaatctcatcaggtgatgaaccaatcaaaccacaacaaaaatctccaacctcaacttcaacgacacctactaaatcatcagaaaccaatttcattccaccaagaaattcaaatgtaggaggtggtagtggcggtggtggaggaggaggatatcaagaatttgatagaccaaaaatccaaatgacttcattttgtccatcaccagagatttcaagagcttgtggtagccctcgccggcctccgaaagtacctgataacattacaccaagaagagccttagctaggtctgcattctcgaagccgaagtctcggtttgttgaaccatctgcaccttcagctgcagatttggttgataaagataaggcgccaccgtctccgtttaggacttcaccgacaaatagagtagctgggggtacacctagagcaggtggtggtacaaagactgcacctgttactccgaagacgccgttcttgtcgtcccctggaggagaggaggatgaggatgaggaaatttataagatcgacaagggtgcacctgcggatgtaacgtcacgcaagtgggaaacaactagaattatcattgaatggattttgttgatttgtattactggttgtttagtttgtagcttaacagttcatagattgcaacgtatgatgatgtgggggttggaactatggaaatggtgtgtcatggtaatggttgttgtgtgtggaaggttggttacggcttggattattcatgttttagtgtttttgatcgagaagaattttttgtttaagaagaaagttttgtatttcgtttacggattgaagaagagtgttcagattgttatatggttgagtttggtgttgttgtcatggacattgttgttcaaccgtggggtaaaaaggtcgagaagtactactaagtttctggattatgtttcgactggaattatttcgttgcttgttggatcagttatatggcttgtgaagacattgttggtaaagatgttggctggttcatttcacgttaacacgttctttgataggatacaagagagtatttttcatcagtatgtacttcaaacactttctggaccaccaatgatggagttagctgagcaggttggggctgttgcaagtacagggcaattgagtttccggagtacgaagacacctaaaggagctgaagcaccggatgtcatagatgtgaataagcttaataagatgaaacaagagaaggtttctgcttggacaatgaagggattagttaatgtgataaggacttcagggttgtccacgatttcaaatacaatcgatcagatatatagtgaacatgatgagcagaaagataaggagattactagtgagtgggaagcaaaagctgctgcttatcggattttccggaatgtcgccaaacctaatagcaagtatatcgatgaggatgacctgatgaggttcttgagtaaagaggaggtggataatgttcttcccttatttgaaggagctgtggagaccggaaaaattaagaagtcatctttgaggaactgggtggtgaaagtctaccttgagcgcaagtcactagcgcattctctaaatgacaccaaaacagctgtgaggcagttgaacaaacttgtttcgggggctgttatcgttattatgattattgtgatgcttctcattatgggcttcttaacaaccaaagtggttgttttcatgtcctcacaaatgttattggttgtttttatgtttggaaatactgcgaaacaaatatttgaagctatcatcttcgtatttgtaatgcacccttttgacgtcggggatcgttgtgttgttgatggtgttcagctgatcgttgaggagatgaatatcttgaatacaattttcctgagatatgacagcgagaagatatactatccgaactccattttagcaaacaaacccataagcaatttctatagaagccctaacatgggtgacgctgtggagttcgccattgatgtttcaactacaattgagagggttggggctttaaaatctaggataaaagcgtacatagatggaaaacctcaacactggcaatgtaaccacagtgttgttgtgaaggagatagagaatgtgaacaaaatgaaaatggcgttatacgtgactcacacaatgaatcatcaaaacatggtagagaaaaacagcagaagaactgaattaatgctcgagttaaagaagatattcgaagatctttccatcaaatatcatcttttacctcaagaagttcaggttagctatattggcggcgcagcagcaccaacgggtttgagaccatga

SEQ ID NO: 439 - DNA, 450 bp, Papaver somniferum
atgagatatgaagttgcattatactatggacccttgatgactatgtatgatggatattcaatgtacgatccacatcgggtaatgcgacaattgtgttacgtccaagaagaacctcatttcgatgaagaaaagccgttctttactgtggacatgactgaatgcagcaggtcccaaaaaactattaacgtctcttacgatccagcaccaactcaagaacattgggacgatagacgtcgttgtaaaatcgatgtgagtcttttggacgaggtgaccaccggtcacgaagctagtgagaaatacatggcgtggtacttgggttgggctcgtcctaccgtgagtagggaaatgactgctgaagaattggctcgtaagaggaagatggcatcgaaagacccagcaacaagtcttaagttctttgtaagtattttagagttgctcttactattttaa

SEQ ID NO: 440 - DNA, 327 bp, Papaver somniferum; identical to SEQ ID NO: 338

SEQ ID NO: 441 - DNA, 2361 bp, Papaver somniferum; identical to SEQ ID NO: 438

SEQ ID NO: 442 - DNA, 1074 bp, Papaver somniferum
atggaagtagttagccagattgatcaagaaaatcaagcaataatctggaaacaaatttatggtttttcggaatcattacttctcaaatgtgcagttcaatgtgagattgctgaaactattcataaccatggaacaccaatgtctatattggaattagctgctaagcttccaattgatcaaccggttaatatcgagcgtttgtaccgtgtgatgcgttacttagttcaccagaaacttttcaacaaggaagttatcaccacgcttaatggtggaaccgttcaagtaacagagaagtactggttagctccaccggcgaaatacctaataagagggtctcaacaatcaatggttccttcagttttaggaataattgatgaagatatgtttgctccgtggcatattctaaaagacagtttaactggtgaatgtaacatttttgagaaagcgttaggaaagagcatttcggtttatatgagcgaaaatcctgaaatgaatcaaatttccaacggagcaatggcttttgatagtggattagttatttcccatttggttaatgaatgcaaaaatattttcggtgatgaaattaaaacactcgttgatgttggtggtggtactggtactgcagtcgcagcaatttccaaagcgttccccaatattaagtgcacactctttgatcttcctcatgttatagctgattcacctgaaattcaaactattaaaaaagtttcaggagacatgttcaagtcaattcctagtgctgatgccatattcatgaagaatatccttcacgattggaacgatgatgaatgtattcacattctaaagcgttgcaaagatgtagtgtcatcgggagggaaacttattattgttgaaatggtgttggacgtggattctgttcatccatattcaaaacttagactcacatctgatatagatatgatggttaacaatggaggtaaagagagaaccgaagaggaatggaagaaactttttgatgcagcaggttttgctagttgcaaatttactcaaatgtcagcaggttttgcagctcaatctataattgaggtctattga

SEQ ID NO: 443 - DNA, 861 bp, Papaver somniferum
atgcaggcatacagtggagctgcaataatgggtgctgctgtacaacaacccaatctttttactaaaggttcttccactttttttcccaagttgagtgctactacggatagatttccttctcaagttaggtttaatccagtgaagacttgtaaagcggcctcttcttcaatcgaagggagcttggttacaggaagaccaccatcttctgtatcagttcctattcctaaaatgggaggtaatggaaggggtttgatagaccgcaatctgagtgaggcagaccctgaggtacgttcaataattgatagtgagaagaatcgtcagtttaacagcttggagctcattgcttcggagaattttacatctcgcgcagtgatggaagctgtgggttcttgtctcacaaacaagtattcagaagggcttcctggtaaaaggtattatggtggcaatgagtacattgataagctagagacactttgtcaacaaagggctttggctgcatttcacttagacccaaagaaatggggagttaatgtccaacctttgtctggttctcctgcaaactttgaagtttacactgcacttctcaacccacatgaccgtattatgggtttggatcttcctcatggaggtcacttgtcacatggatttatgactcctaaaagacgggtatctgggacttcgatttattttgaatcgatgccctaccgtcttgatgaatcaacaggctttattgattatgatatgcttgagaaaactgccaccctctttcgaccaaaactcatcattgttggtgctagtgcttatcctcgtgatttagattatcctcgaatgagaaagattctgttcgggcttttctcatga

SEQ ID NO: 444 - DNA, 795 bp, Papaver somniferum
atgggaagtagcagtatagatgtgaaaccagctgaaacacaagaagttagcatcaaagatcaagctcaattatggaatatgatctacggttttgctgattctcttgttgttcgttgcgcagtagagcttggcattccagatattatcaaaaacaataacgggccaatcacacttgcacaactttcatcaaaactcccaattccgaatgtcaactcggatcacttgtacagaattgtaagatatttaataaacctgaatatcttacaacaagaaatttgtcgtaatgttaaggtctactcacttaaaccagttggtactttacttttaagagatgcagaaagaagtatggtgccaatattattaggcaatacacagaaagatttcttggttccatggcatttcgtgaaagaaggtttagtaaatggaagtacaacagcatttgagaaaggaatgggtatggatatatggaagtatttagaaggtaatccagatcaaagtcagttgtttaacgaaggaatggctggagaaacaagtcttttaactaaaactctaatcgaagattgtagagatactttccaaaatttggattctctagtcgatattggtggaggaaatggtacaacaattaaggcaatctatgaagcttttcctcatatcaaatgtacgctttatgatcttcctcatgttattgcaaactctgatgatcaccctaacatccgaaaagttcccggtgatatgttcatgtctgttccaagtgctcaagttctcttactcaaggtgaaaattctaacttaa

SEQ ID NO: 445 - DNA, 558 bp, Papaver somniferum
atgaaagatcaagtgaacgatagaacagatgaatatggtggaaccattgagaaaagatgtcgctttgctctagaagttgttaaagccgttgtagatgagattggagcgaacaaagtcgggatgcgaatttctccctttggtgatttcatggaaacaggagactcaaagcctgaagctctcggccttttcatggctgaatcattaaacaaatatgaaatcttgtatctccatatgatagagatgatgaaggttgacgaagatacctctgtaacaccatacaacagcttaccgatgaggagagcttttaaagggacttttatttctgccggaggttatgagaaagaagatggaaacaaaatgatcgataaaaatcatgcagatctcattgcatatggtcgactatttttggcgaaccctgatttgcctaaacgtttcgccgttgatgcgcctcttaacaagtatattagtgatacattttgcattccagacccaattgttggttacactgattatccatttctagatcaaagtattagttcaactaattgcagtaaataa

SEQ ID NO: 446 - DNA, 945 bp, Papaver somniferum
aaaagcctagaggtaaagagagaaataaagatggagattgtcacagtagcacttatagcaattgttttcactactttcttatacctgatagttagagaatcgagtcctaatggcttgccaccaggtccaaaaccctggccgatagtcggaaaccttcttcaacttggtgagaaaccgcattcccaatttgcccaacttgctgaaacctatggagatctctttacactcaaactaggaactcaaacagtcgttgtagcttcaacaccattagcagccagtgaggttctaaaagcacatgatcgtactctctgtggtcgatacgtgttccaaagtttccgcgtaaaaaatcatgttgagaactctattgtttggaatgaatgtaatgaaacatggaagaaattgcggaaagtttgtagaacacaactttttacacaaaagatgattgaaaatcaagctgaagttagagaaataaaaacaatggaaatggtgaagtacttgaagaaaaatgaaggaattgaagtgaaaattgttgaagttatatttggtacattagtgaatatgtttggtaacttgatattttcacaagatatttttaagttgggtgatgaaagcagtggaagtctagaaatgaaacaacatatatggagaatgctggaattaggaaattcagcaaatccaggcgattatgttccacttttgggtagtttagacttgtttggacaaagaaaagatgttgctgattgtcttcaaggggtttatggtgtttggggtgctatgcttaaagaaagaagaatagccaagcgacagattaatggcgatacgaagaatgattttgttgatgttttgcttgattctggactagatgatcaacaaatcaattccttgctcttggtaagctcaatattctctttccatatacaaacttttctgatatacagatattaa

SEQ ID NO: 447 - DNA, 1635 bp, Papaver somniferum; identical to SEQ ID NO: 359

SEQ ID NO: 448 - DNA, 245 bp, Papaver somniferum
atggatattttgatgaagttgttattgttacatgaaccaataactctttatatcgttctggttatagtttctatcgttcttctatacaatgtcttcttcttggttactcccaacaaaaacaagaagaggaaagcacctaatgcatcagggggatggccattgataggtcatttccatctatttataagtggtaaggaaatagtgtatagaacactgggaaccatggctgataagtacggacctgc

SEQ ID NO: 449 - DNA, 348 bp, Papaver somniferum
atgggtagtagtatagatgctgaaacacaagaagttggcatcaaagatcaagctcaaatatgggatataatctatggttatgctgattctcttgttcttcgttgcacagtagagattggaatcgcagatattatcaaaaacaataatgggtcaatcacactttcagagcttgtatcgaaactaccactttcaaatgtgaattctgataatttgtacagaattctaagatacttagtacacctgaatatcttaggacaacaaacatgtgctgctggaggtgatagggtttactcacttaaaccagttggtactttattattaaaagattcagaaacaagtatggtacca

SEQ ID NO: 450 - DNA, 204 bp, Papaver somniferum
atgaaaatcttaattttcgttacagtgatatgttgttttttatcctccttgttttacagtgatggaattgttggagcaaatgctcggtggaggccatctcaggtcagtgattcggaaacgagaattggggaaaagctacagtacatggtacctactttcctcagggcggtggaaattttagcagaacaaggaaggaatccctag

SEQ ID NO: 451 - DNA, 5886 bp, Papaver somniferum
atggatgaaaatagggttcctggaaataatgggattggtaatggtaatcgttcagctgacgatgcttcttattggttagatgcttgtgaggatataccttgcgatctgattaacgatattgttgattttgatcctgttgttcccacccaagtagtaattgatgacactgcacatcaaggtgttgattttttcggtggaattgatcggatactggagagtattaagaacggtgctggtttttcggaaaatgaaattgttgcaaccggtgttgagtctgagaatatggtgactgatggaagaataattcaatcagcggaagtgaacggagaagcgcaaaaggaaaaattggcaaaaactgaactcaaaagtgatgggttttgtctgattattagtggtggtgagaaaaaatcatctcaaactgaggtccatggcaaggaaatatcgaaatcatctaaagctgaggtccatgtcaaggaaatatcaaaatcatctcaaactgaggtccatggcaaggaaatatcgaaatcatctaaagctgaggtccatggcaaggaaacatctcatagtaaacatgaaagaggtgacagggaggttaggagagcgagacatgtcgaacctgttgatagacatggcaaaagagctcgacttagtgactgcagtcgccatgatcgctctaacgaaagattgagcaagaagaggccgagggattatgagaggacggacatggatagggatagaggccgggacagggatagagaccgaagcagtagaagagaccactatagctatagcagtgataggaagggtggtagggatccagatcgcagagatagtgatagagatagggatagggctagaaaaggttactgggaaagggatcaaacgggtaaggttgtttttcattctggttcgtgggagtacgaacatgagcgagaggcgaagagagtcaagaaacaaaaccttgaaaagtgtgagaacattgagaagaaacccgaggagaagagagaaaaaccagttgaggaattggctaggaagtatcagttggatgtgcttgaccaggcgaagaagaaaaatacaatagcttttcttgaaacaggaactggtaaaacactcattgccgttcttcttattaagagtctttgcaaggacatgatgaaggaaaataaaaaaattctggcaatttttttggtgcccaaagtcccccttgtttatcagcaagctgaagttattagggagagtactggctacaaagtaggacattactgtggtgagatgggtcaagatttttgggatgctcgtagatggcagcgtgaatttgaatcaaatcaggtgcttgtaatgacggctcaaattctgttgaacattctcaggcacagcataataaaaatggaaaccatcaacctcctcattcttgatgaatgtcatcatgctgtcaagaaacatccatattcattagtgatgtctgagttttatcatagaacccctaaagagaagcggccgtctgtttttgggatgacggcgtcacctgtaaatttgaagggtgtttctagccaggaagattgtgcaataaaaatcaggaatcttgagagcaaactagatgcaattgtttgtacaataaaagaccgaaaggagttggagaagcacgttccaatgcccttggaagttattgttgagtatgacaaagcagcaagcttgtggtcacttcatgaaaaaattaaaaaacttgaagtagaagtcgaggaggcagcgcatatgagttccagaagaagtaagtggcaatttatgggtgctagagatgccggatctaaagatgagttacgccttgtgtatggactatctgaaagaacagaaagtgatggtgctgctaacttaattcaaaagttgagagctattaattatgctctgggtgagctagggcagtggtgtgcttataaggttgctcttgcatttttgacagccttgcagaatgatgaaagggcaaattaccagcttgatgttaagtttcaagaatcgtacctgagtaaagttctgacactcttacaatgccaattgtctgaaggagctgtctctgatgaagaggcaaaaacatcagatatggaaagcgatgatgttaaatgtgacgataaccttgatgatgttgaagagggagaacttcctgatagtcacgctgtctctggtggagagcatgtggatgttataattggagccgctgtagctgatggaaaggttactcccaaagttcagtcgttggttaaaatacttctcaagtaccaacacacagaggactttcgtgcaatagtctttgtggagcgagtagtgtccgccttagttcttccaaaggtctttgccgagctcccatctctaagttttatcaaatgtgctagtttgattgggcacaacaatagtcaggaaatgcgcacatcccaaatgcaggacacaatagctaagttccgtgacggccgagttacactattagtagctactagtgttgcagaggaagggttggatattcggcaatgcaatgttgtcattcgttttgaccttgcaaaaactgtattggcttatattcagtctagaggtcgtgcaaggaagcctgggtctgattacatcttgatggctgagagaggaaatttgtcgcatcaaacattcttaagaaatgctcgaaatagtgaggaaaccctacggaaggaagcaattgaaagaactgaccttagtcatctcaagggtacttctaaactaactactgtagacacaacgccgggttcagtataccaggtcgaatcaactggagctgttgtgagtctaaattctgctgttggtctcgttcacttttactgctctcagcttcctagtgacaggtattctatactgcgtcctgagttcattatggaacggcatcagcaccaaggaggttcggttgaatattcatgcaagcttcaacttccttgtaatgcaccatttgaaaagcttgagggtcccatttgctcttcaatgcgccttgctcagcaggctgtttgtttggctgcttgcaagaagcttcatgaaatgggtgcatttacggacatgctcttgccagacaagggaagtggggaagaaggagagaagcttgacgagaatgcagtaggagatccgcttcctggaaccgcaaggcacagagaattctatcctgaaggggttgctgaaattttgcggggagaatggattttatcaagtaaagatacttgccagaagatggttaatctgcacatgtatgctgtaaaacttgtggacgtcggcgcttcaaaagaccctttcttaacccaagtatcagattttgcagtactttttggcagtaagctggacgcggaggttttatcaatgtcgatggacctctttgtagctaaaaccatgataacaaaggcatctcttgtattccagggatctattgatattacagtaaatcagctggttttgttaaagagctttcacgttagacttatgagtattgtgctggatgtgaatgttgaaccttcaagcactccgtgggactccacaaaggcatatttatttgtccctgtcattagtgagaagtgtattgatccttcggaaggaattgattggggtctagttgaaacaatagtagggacagatgcttgggaaaatcctcttcagagggctcgtcctgatgtttatcttggcacaaatgagcgtacacttggtggagatcggagggagtatggatatggaaaattacgtcatgacatggcatttggacagaagtctcatcctacgtatggtatccgtggggccattgctcaatttgacgttgtgaaagcttctggtttgcttcctaatcgggttgccactgagaaccatagtgaaattttgggccaaggcaagatatttatggctgattcgtgcattaatgcggaaagtcttgttgggagtattgtgactgcagctcactctggaaaacgattttatgtggattctgtgcgctatgacatgaatgcagaaaactcctttccgaggaaagagggctacttaggccctcttgaatatagttcatatgctgattactacaggcaaaaatatggtgtggatttgatttacaaaaaacaacctcttattagaggacgaggtgtttcgtattgcaagaatcttctctctccccgattcgaacattctgaagcgcatgaagatgagtcggatgaaaatcttaacaaaacatactatgttttcctccccccggagctgtgttttgtacatccacttcctgggtcacttgtacgaggagcccaaaggttgccttcaattatgaggagagttgaaagtatgcttcttgcagttcagctgagggatagtattaactatccaattgctggttccaagatcttggaagcattgactgctgcgtcgtgtcaggagacattctgttatgaaagagctgagttacttggagatgcttacttgaaatggattgtaagcagatttctattcctaaaatatccacaaaaacacgagggccagcttacaagaatgaggcaacagatggttagcaacatggtactttatcagtgtgctctgaataaaggtcttcagtcatttatccaagctgatcgatttgctccatctagatggtctgcccctggcgttcttcctgtatttgatgaggatacgaaggacaccgagtcttccttatttgaacccgagagcaactcttctgatccacataaggttgccctagataacaacggatatgaggatgatgatatggaagatggtgaggttgaggttgagagtgactctagctgttacagggtcctctctagcaaaacgctggcagatgttgtcgaatccctgattggggtatattatgttgaaggtgggaagaatgctgcacaccatcttatgagttggattgggatagaggtggaatttgaccctgaggaggtggatgctgttaaaaagccgtgtagtgttccagatagtgttctgaaaagtgtcaactttgatgctttagaaagttcattgaatattaagttccacgataagagcctgttattggaagccattactcatgcttcacggccttcagccggggtttcttgttatcaacgtctggaatttgttggtgatgctgtcttggatcatctaattacaaggcacttgttttttacgtacaccgatctacccccagggcgtttgacagacttaagagctgctgctgtaaacaatgagaattttgcacgcgttgttgttaagcacaagcttcatttgcacctccgacatgggtcaagtgcccttgaagctcagattcgggactttctgagagatgttaaagatgaattgttgaagccagggttcaactccttcggtgtaggagattgcaaagctcccaaagttctcggagacatctttgaatccatagctggtgctatttttctagacagtggacgagatacctctgttgtgtggaaggtgttccaacctttgatgcatccaatggtgaccccagaaacacttccaatgcatccggttagggaactccaagagcgttgccaacaacaagctgaaggccttgaatataaagctactcggagtggaaatttggctactgttgaggtgtatatcgatggtgtacagattgggattgctcaaaacccacaaaagaaaatggctcaaaaattagctgcaaggaatgcacttgttgttctaaaagaaaagcaagagatcgaagaaaaggagaagggtgagaatgggaagaagaagaatggcaatccagcatttactagacagactcttaatgatatatgcttacggaggcaatggccaatgcctcaataccggtattttttcttgtttgtatttgaactatggatgagctatggcctaaccagcttttga

SEQ ID NO: 452 - DNA, 324 bp, Papaver somniferum
atgaaaaacaataaagctacgaattccatcatattcaagagaactccgtacttctattttctattgcctcgcgatataaagagcattacagccaggattacaggttctacttgttcaacaaactcagagtacattttgcccaaaaacctgatcataaatttcattttctcggcttgcctaatgagcaccttcatgccccctttaagtgcttattgttttaggggggctttcttttgtctgtcagatattctggcaggagcattagaatgtgacttgaaccgacctcggcctccttcatcagtttcctttttcttcaaaatctga

SEQ ID NO: 453 - DNA, 792 bp, Papaver somniferum
atgcctctcatgaaattccatcctggtagcatgggcgtggacgcaaaactgatcacaaagacccttgacgagtgtgtttctcagccagataatgagaatggagataaagatctgaaggctaaattggcacctcaacaaagtgaacagccgattgcggctgaacaaaagaaagaagaggaggatgataaggagaatcataatgatgtgaaaacctgcattagtgtcgagcagcaggttgaaatggaaaatctagacgtagctgaagacaattcagatcacaatttaagaactcagtccaccactaaaggtgagcccataaggaaacatcatcgagcttggactctcagtgaggttacacaactggttgagggtgtcgcaaggtttggagctgggaggtggtctgagatcaagaaacttagctttacatcctattcttaccgaacttctgttgatctcaaggataaatggaggaatttgctaagagccagctacgcacgtcctccagctgtcagagatatgttaaactcaaagaagcaagcttctgcggccctccctgcacacatacttctacgtgttagagagcttgcagaaaagcattcacagggaccaccacccgatctagcccggaaagtaggaaacatcagaggtcggaaaccaggaggcggtgcaggaatattcggccgcaaaatagtaggcggagtaggaaaaagccacaaagtaagaggggtaggaggagtcgtctctgctggtagtaaacctattgtaaatgaaacaaggtctggtttcttgtag

SEQ ID NO: 454 - DNA, 546 bp, Papaver somniferum
atggttgctggaataattccttttgatgataagaaacccatccaggcagcttttgctgtggtaaataagaagctgagacctgttattccgaagggttgtccacctccgttacgagatctgatcgagcactgttggacttcagcttcagagaaaaggccagaattttggcagattgtgtacacacacttggatcatctggtcgtggacatgtgcacttcaaatggctacatgaaagtggattcgtatattcatgccgcctttctccaagcgtggctgtgggagcacttcgaaaggtatgctccaaaaccgttggccttacttcccgagtcttggggtggctctagaatactccgctggtcgaataggcgcccaaagattggttcgaaactgattggattccttgacaactcgcacacgatcaatttccgtccatgggctccgatgcatgcgtccataactcaaatcaatacctttgctcctgttccgagcatgtctttgtcttctgataaagaggatacgagtgttggagagatggtgttcatgtga

SEQ ID NO: 455 - DNA, 1032 bp, Papaver somniferum
atgtctagttctacatcaagtggaagtttttcgaaggtgcatggatttgatattatcaaattcaacgggaagaataattttacatcatggcaaattgatgttaaagatactcttgttagtatgaaacaaatcaaagcgatcaaggacaaaccagcagcgttaccaaaggaatggagcgatgagaagtgggatgaccttgttttggaggcgtgttcaactattcggttatgtttgtcaagggagatcactcataatttttcgagtgaaacctctgcaacggtgttgtgggataagttaaagaagctctacttgcaaaaggatttgacttcagagctttacttgaagcgcaggattcatgcctttcggatggcttcaggtaagcctatggttgatcatattaacgattttaataagatctgttctgatttatctaacatcagtgtgactatttctgatacggacaaatctatgatattattatgttctttgcctccatcgtatgatgctttcgttgactacttgctgagtgtgaaaatcgaaggagacaataagttggttttcgatgatgtggtcgctgctttacaagctaaggcattaaggaaacaagagttaagcgatgaagcacaagccgagggtttgtttgttgatagaggaaagaatagtaataagaagcagaagtcgaagaatcgtttcaagaagaacgatattgagtgttattattgtcgtaaaactggtcatattagggttgattgtctcaaacttaaggcaagagatgagaaacgtgagaaatcagatttgaagaatgttgttgcttcggtttcggaaggcactgaagttttagaagacccaatgtgtggttttgatgaggaagtgttaaccgttacatcaaagagttatctcaatgatggttggatgcttgattctggtgtttcgtatcatatgtgtccttcaaaggattgtttcaatacttatagagaggtgaatggtggtacttttatgatgggaaattctaatgcctgcaaaacagtttga

SEQ ID NO: 456 - DNA, 957 bp, Papaver somniferum; identical to SEQ ID NO: 213

SEQ ID NO: 457 - DNA, 1377 bp, Papaver somniferum
atggagaatacaataggaaaatcgaacacaggagataaagctaacgttcgtgtagttgtagttggtgactctggaactggtaaatcaagtttgattgttactgccgctgctgaaactttcccacagaatgttcctcctgttctaccacccactcgtttacctgctgatttttatcctgatcgcgttcctgtcacaatcattgatacttcctctagtatggagcatcgcactaaacttgctcaagaattaaagctagcagatgctgttgtattaacttatgcatgtgatacacctgcgactcttgatcgtttaagtacgttctggttaccagaacttcgcagattagaggtgaaggtaccagtgattgtggtgggatgtaagttggatgcgagggaagatacccaagtgagccttgaacaagtgatgtctccgataatgcaacaatttagggagattgagacttgtatcgaatgctcggcgcgtagccttattcaggttccagaagttttctattatgctcagaaggcagttcttcaccctacagcaccattgtttgatcaggaaacacagactttaaagcctcggtgtgtgagggctttaaagcggatatttattctctgcgatgaagatagagatggtgctctcagtgatagagagttaaatgactttcaggttaagtgtttcaacgctccactccagccttctgaaatagtcggtgttaagagggttgtccaggagaaactgtccgagggggttaatgaccgtggtcttaccttgacaggtttcctttttcttcatgcactatttatagaaaaaggccgtcttgaaacaacatggacggttctgaggaaatttgggtacgataacgagattaagctccgagacgatctgattccactttcattcaaacgtgctcctgaccagagtgtggagctgactactgaagctgttgatttcttgaaaagcatcttcaacttgttcgacctccatggtgatgccgcattacgacctgctgaacttgatgatcttttttcaactgcaccagaaagtccttggagtgaagctccatataaggaatctgcagagaagactgcattaggagggttatcctttgatggattcttggcacagtgggcccttatgacattgttagatccggttaaaagtgtagccaatttggtttacatcggataccaaggagacattgcctctgtactgcgtataaccagacgaagaaggttagatcgcaagaagcaacaatcagatagaaatgttttccagtacttcatgtttggacctaaaaggtgttgggaagtcatcatttatcaactctttactcggaaggtatggtacttgttgaagttattgataaaataa

SEQ ID NO: 458 - DNA, 501 bp, Papaver somniferum
atggcagatctccaagtgaaaaaaattcctaaactaccaattcctggccgtagaaacattatgattactagcgcattaccttatgttaataacgttcctcaccttggaaatatcattggttgtgttttgagtgctgatgtcttcgctcgttattgccgtctcagaggttataacacgatttatatgtgtggtacagatgaatatggaacagccactgaaaccaaagctatggaagaaggatgtacacctaaggagatttgtgataagtatcatgcgattcacagagatgtttacaactggtttgacataagttttgatgagtttagacgcccttctagtccccaacagattgaagtttgccaagcaattttcaaaaaactgatggagaacaactggctttctgaaaatacaatgcagcaggtcgtgcatttacaggtcagtggtccttcaaagccattgagtgagcttgatgatccagcttggcgactagcgtttgggtag

SEQ ID NO: 459 - DNA, 300 bp, Papaver somniferum
atgcagttggttggtcttactgccctcttattggcatcaaaatatgaggatttttggcatccgaagctgagacaagaacttgaagaacttcaggttcactccatgctacacacactaaggcacgatgggaaatcaaaactagcgctttcaagattcagtagatgcataatgctggtggcttatggagcctatctcgttttccagctgttcagtcacaagcacttatacgaggttggactctttaatgctttcagaattatttttttcttcatactgtggcagttttggttatccttataa

SEQ ID NO: 460 - DNA, 495 bp, Papaver somniferum
atgagtacttcaaattcaaagtttataaaatgtgttacagttggagatggagctgttgggaaaacatgtcttcttatttcctacactagcaacactttcccaacagattatgttccgactgttttcgataacttcagcgcaagtgttcttgttgatgcccaaattgttagccttggcctttgggatactgctggtcaagaagattacaacagacttagacctctaagttacagaggaactgatgttttcctgcttgctttctcactgatcagtagacccagctttgagaacattaccaagaaatggattcccgagctacgacattatgcaccatcggttcctattgttctcgttggcactaaactagacttgagagaagacaaacagttccacatcgattaccctggagcatatactatatctacggcacagggtgaggaactgaagaaacagattggtgcattagcatatgtagaatatatttctaagaactaa

SEQ ID NO: 461 - DNA, 495 bp, Papaver somniferum
atgaagacatctctagaaatattatctgattttaagcaagcgacatctgcatatcgagaaggttcctgggaattccctattgatgtttcaactcgatggagtggcaattatgctatgctggatattgcacgcagggcctctaaatccatggatgctgttattagaaaccacgaagagtctctagctagttgtagcatgcttctggaccctgcggagaaagttgctgtcagtatcatgcaccaataccttggtcctttccaccagatcacaagcagcatatgcacaaccaaagacccagctgtcggactggtattatctctcatggatgatgttgttaagatggttgcttcttgtgacaccccagactggctaaagattggtgctgaagacatgggaaaaaagggtaggagctacaactgcggattaagggtgagtacatccctgaaaatctctactcagaaagccatctggaagaggcaaggaactattttatga

SEQ ID NO: 462 - DNA, 285 bp, Papaver somniferum
atggatataaaatccgcgttcctaaacggaatttcaaaggaggaagtctatgtcgctcaacctaagggttttgaaaaccctgatttcccagatcatatgctaaaactcaaaaaggcattgtatgggttgaaacaagcacctagatcttggtttgaaaaacttaccacttctatcattagaaaaggtttttcaagaggcggagctgataaaactttgtttacaaaatggagtggaaaagatgtggctatttctcaaatctatgtagatgatatcatctatggataa

SEQ ID NO: 463 - DNA, 234 bp, Papaver somniferum
ctgagcatcctcctacaaaacacaatgcaaagaatcgtcaaccttcaccttccacataagaaccagccggataaaataacccggcccttcacaaaatcagaaaaatacatgacgccttcaggatacaaatgcctaacagacatttcagatcaattgcagcataacccaccaccccctccaaccaacttcctatggacactcccatgtccaccaaaagtacaacttttcttgtga

SEQ ID NO: 464 - DNA, 222 bp, Papaver somniferum
atgaagagaaactggaacatacatgagaaaccagactctatagtgtcctcgttgtacaacgagaaataccttaaacatcaaccaatcctccaaaacatccctcctcctccctcgtccacaatccccctttggaggaatctggcttccctcataccaaccctaaaaaaacatctctttcaccagataggaaacggctccaccaccccaatccaagcaaactag

SEQ ID NO: 465 - DNA, 261 bp, Papaver somniferum
atgggtaaagggaagcgtcagaagatcccttctagcagactaaaaggatttgtgatgcacaccattcgagaaaatagtctacctcatcctcattctacacaatcatcatcctcagctataactgctgggtctgaaccgcgcaactttaaagaagccatgaagcatccagggtggaggaaaccatggaagcaaaaatccgagctttggaagaacaaggtacctgggaattgcaagaattaccaccgggcaagagagcactag

SEQ ID NO: 466 - DNA, 345 bp, Papaver somniferum
atgcaagatgatgtggctaagttggttagagggtataagttgtgcagcacatctaaaccttctaacatgacacgtgggttatatttaccattaccagtaccatcaagaccttgggagagtatttctatggattttcttggtgggttaccgaagaccaagtctggtcatgattatttgttcgttgtggtcgaccgattaagcaagatgattgcattaattccatgtacaaagacggtaatgggagccgacgcaggaaagctcttctttaagcacgtgtggaagcattttggtttacctacttcgattctttctgatagggatagtcgattccttagtcacttttga

SEQ ID NO: 467 - DNA, 258 bp, Papaver somniferum
atgttggcgaaatcagaaggagaactaggttttgagactgggaaaggaccggagcaaattcatttggcatttacagactatgaagatgaaatgagggttatgttcataactgaagatggaaaacacaattatgtcaagtatggaacagatggaggtgacatgaataaggctgtgaagacattagtcagcaggtatgaaagggaagatatgtgtgatgctcctgctaatcatagtattggatggagagatcctggtttt

SEQ ID NO: 468 - DNA, 258 bp, Papaver somniferum
atgaaccaacagatatacactagatggcggctaagacggttgggggtaacaactaatagtatcagatcatgtaacatgatagagagaatggtgtacccagtgactagcaacaacttctcttttactcccattcaatctcttcgtatcccaaatttccaaccttttcaattattagaaggtgccagtttggtttctttggcttcttttgcgcaattccgtacaaatcacaaaacaaaactcattaaaaggaacatgtag

SEQ ID NO: 469 - DNA, 327 bp, Papaver somniferum; identical to SEQ ID NO: 216

SEQ ID NO: 470 - DNA, 2556 bp, Papaver somniferum
atggctgaatcggaatctacattgaatatcaaacaagaaacgacaccgattgattcgattaaagaaagaaacgaggagaaacagaatcttagtaacggaggagattcaaaaaaatctgatgttcaagtaattgatcttgatagcagtagtggtggttctgattcagatgacgacgacgataatgaagatagtgatggagatgctcacatgtctaaagattctagggttggtggtggtggtagtaataagaggaagaagaagaaaagaaggattgataatagaggggtagtattaccacttggatttcttgatccattacctagtaaagataaagatggtgctgttccgaaacctcctgctacgcctaaagatgttgtggttccgaaacctcctgctacgcctaaagattttgttgcttcaaaacctccgaatactccgaaagaggttgttgtgccgaaaccgaaagatgtagttatggtacagacatgtaaacagttttggaaagctggagattatgatggaggtggtggtgtggtggaggatccttttgctttttctactggtggcatggatcatgtgagggtacatccaaagtttctgcattcaaatgcaaccagtcataagtgggctcttggagcctttgcagaattgttggataattctttggacgaggtctgtaatggtgctacatttgtgaacattgatatgttacacaacataaaagatggcagtgagatgctgctggtggaagatgacggcggaggaatggatccggataaaatgcggcaatgcatgtctcttggatactcggcgaaaagcaaactagcaaatacgataggacagtatgggaatggttttaagacgagtaccatgagactgggggcagatgttattgtcttctcacgctgtcgtggaaaaaatgggaatagctctactcaaagcattggattgttatcctacacattcttaaggggcacaggcaaggaagatattgtggttccgatgcttgactatgaaaaagagggccgagaatggaaggaattgattcgatcgtcttcaagtgattggagtagaaatgtagacaccattgtgcaatggtcaccatttgcaagtgaagcagatcttttgaaacagttcaatgggatcggtgagcatggtacacggttaatcatttacaatctgtgggaggatgatcaaggtgaactggagcttgattttcaatccgatccacatgacatccaaataagaggggtcaaccgagacgagaagaagatagagatggcgaaaaaattccctaactctagacattacctgacctatcggcactcattaaggagctatgcatctattctctatctcagaattccacttcgcttccgaatggttctccgtggtaaagatattgttcatcacaatctcattaatgatatgatgttagctcaagagattacttataggccacaacctggtgctgacgggatgctgaaggatcctaatgtggttgcaactgtgacgatgggatttgtaaaggacgctaaagaccatattgatgtccaaggattcagtgtttatcacaagaaccgccttatcaagccattttggagggtttggaatccctcaggaagtgatggtcgtggagtcataggtgtactggaggctaactttgttgagccagctcatgataaacaagggtttgagcgtacaactgtgcttgctaggcttgaagcacgacttgtccagatgcagaagacatactggaccacactctgtcataaagttggatactcgtgtcgacgtaacaagaagcttgtagcagctggagatagttcgcctgattttcttcttcggcaatcatccaaaagtacgatgggatctacatcatgttgggaacctgttaacggaaatgggaacatgtacggtaaaggtgagaatggaaagccaaccagcagatttcgacctagatcaagttcttcagaagaggatgacagtgactctgaaaggccgcctggcattcgaaagaaaacaaaataccagtggcaaaagtcgaaggataggtcagacataaacagtagtgaatctgatgtgattatacaacagttggaagcggagaatagtgaattgaagaacagtttaagcaaaatgaaagaatccttcttgcgtgatattgactatgaaagggacagagttaaacaactaactacactattaaacgggaatggccctaccaactctgatccagcgactctaagccggctgcggacggagaatcatgaactgcaggacagaatgaagaaaatggaagcattgttctctcatgacgtgcagtctgaaaaagagagatgtaatttactacaggctaaattaaaggaatcagaggaaaagattgtagaaatgaataaagaacaggaagccttcattgatatatttgccgaggagagatgccggcgagagaaagaggaggaaaacttgaggagcaaattaaaggatgcttctaataccatacaagagttgctcgataaagttcggcagcttgagaagtccgacggcagaacttaa

SEQ ID NO: 471 - DNA, 255 bp, Papaver somniferum; identical to SEQ ID NO: 420

SEQ ID NO: 472 - DNA, 2256 bp, Papaver somniferum
atggcggaagaattcgtgaaatcagtagaagatggaatcaaactctctaaacgaatctatttcggcaaagacagaaatgttacaccgccgagagcaatatcaattgtatcggaaaaacaacaacaatatttgccggcatctccgatgatgtatggtgtaatttctgatccatccattgttgataatcctgatatacctagttatcaaccgcatgtacatgggagatgtgatccgccggctttgattccgttacagatgaatagtattgaaatggaggtgaatgtgtggttggatactgtttctgtaagtatggttggatcttggcgtgttcattgtgtgatggggagtcggagttgtgattgtcggattgctattcctatgggaaatcagggttcaattctaggtgttgaggttgaagtcaacagaaggtcttttcattctcaactgacttctgtggaagacactacagattgtgtaaagttggcgaaagttgaagatggtggctttttgaaacccaatatatttaccttgacgataccgcagatcgatggaggggcaaatatatctgtcaaagcaaattggtctcagaagttggcgttcgatgctggtcagttcactgtgaatataccatttagttttccagaatatgtaactcctgcagggaagaaaatcgcgaagagagaaaaaataaaattgaatgtgaatcctggtattggatcagaagttttatgcaagacatctagccatcctctgaaggaaataagacgccaagcaggaaaattggctttctcatatgaagcagatgttcttacatggtcaaatatggaatttaatttctcttatgcggtttcttcaaaagacatatctgctgggttgctgttgcaatctccacctgttgatgatttagatcagagagagatgttctgcatccatcttcaccccggcaatcatcagactagaaaggttttcagaaggaaagtggtatttgttattgatacaagtgcaagtatgaaaggaaagccccttgaggctgtgaagagtgcactctctgcagccctctctaagctcaaccccgaggattctttcagcataatagctttcaatggagagacatatttattctcttcgtccctggtgccagcaacaaaggaaacaattgaaaatgccactcagtggataagcattaactttatagcagaaggtggtacaaacatattgctacctttaaatcaggcaatagacatgctatctggtgctgaatcttctgattcagtccctctcatttttcttctaactgatgggactgtggaagacgaaaagcatatctgtgatgttatgaaaagtcatatgaaaaataaagggtctatgtctccgcgtatctctacatttgggataggcacatactgtaatcattatttcttgcaaattttggcacaaatcagcagaggctattattatgcggcttatgaagtagattcactctatgtccggatgcaaaaattacttactgaagcctcttccattatttacgcgaatatcaccattgacagtattgataatcttcaggaacttgaggtttatccgtccctatttccagacctgctatctggaatgccattaactgtttcaggcagatacgaagggaggtttcctgattctgttaaaattaaaggcgttttagcagatatgagcaattacgaagtagatttgaagctgcagcaggcgaaggatatacctctcgacagagtattcgctaaaaggcacattgatgtactcactgctcaagcttggtacacccaaagcaagaagctggaagagaagattgccagaatgagcatacaaactgggattccatctgaatatacgcgtatggttgttcttcagaacgatggagggaagaaagcctcagattcaattgatatacaagaggtaaacaaattggacttgcagaagaaggtcgactccgaaggtcgaaaaataatgctgctgcaatgcttgggaattggttttggcaacctaacagccacaacggaaagtatacctcctggatggggagaacctgagttaccagaacctgtcgcagatgcatttgtgaaagcagcttcaaactgttgtagcagtcttgcagatttgtgttgttgcatgaactgcatcaggtgttgttccagtatgaataaccaatgtggcattcttatcgtacaactttgtggtggtttggcgtgcttaggctgtttcagctgttgtggagatgattga

SEQ ID NO: 473 - DNA, 234 bp, Papaver somniferum
atgcctcatcaatccgaacaagatactgtagaagatcagaacccttcctgcacatttccatgtcagatatccttgatagaaggatggaaaacagatggtgaatgtgaaaagataacaaatcctgtaaagatgagagcctcgatcttcaagtttgaggtagaagattggtcctttaatgcttttgcaatttcggaaacaagagtcccaatcgatgtctgcaaggcagtcatgtag

SEQ ID NO: 474 - DNA, 957 bp, Papaver somniferum; identical to SEQ ID NO: 213

SEQ ID NO: 475 - DNA, 246 bp, Papaver somniferum
atgtccatgtgtcgtatttcagagaactttgcttcagcagtagcagtcgagagcaaagtcaattctttcaattctcccttgccttccttccggatctctataaagccttccaacatgttcggtagtagaatataccggttaaatttgcaagagaacatattccgacaaagtgttggaaagaaagaatggatcaagtcttactacaaaatgtggaaggccgcagttgagagcttcgtgccaggttag

SEQ ID NO: 476 - DNA, 354 bp, Papaver somniferum; identical to SEQ ID NO: 401

SEQ ID NO: 477 - DNA, 1071 bp, Papaver somniferum
atggacactatcaagagaaaatatcttatgttgttcaattccgtcttgttagcaattggtgccactggcggtccacttcttctccgtctctacttcgtccgcggtggtaaaagaatatggctttcgagtgcgctaggtagtgcaggttggccgattttaatcctccctctctcgctttcatacatcttcaagcgtggcggtggtggcgaaaatggcagagtcaaatttttcaccatcacaccacctctgatcatatttagcgcttttatcggtttactcttggggttaaacgattatttatacagtcatggggtttcgcttctcccggtatcgacatctacgttgataatgtccactcatttggcatttacggctggttttgcatttgttcttgtgaaacagaaattcactccgtattcgataaatgcagttgtgttattaacggtcggagctatacttcttggtcttcattcgaatggtgataaacctgtaaatcagtcgaacagagattattatttcggtttctttctcacggttggagcttctgtgatcagtggattgttgttcccattggcggagttgatgtatattaaagctatgcaagctttaacttacagtttggtgatagaaatgcagattgtgacggctgtggttgcttctcttttctgcattgttggaatgattatcaacaatgacttcaaggcaattccaagtgaaggtaaagaatacgagctcggggaggtcaagtattacgtagtgctggtatctattgccattatgtggcaaatttacttcgtcggaacagcaggagttatcttctgttcgacttctttgcttgctggtattatcactgccgttatactaccggttaccgagatcctatctgtcgtgttctaccatgagagtttcaaatcggaaaagggtattgccttattcctctcattttggggtctcatctcttacttgtacggtgactacagagaaaacattaaattgaagaaggccgcgcagaagcagagttcggaattagaactagacgaaaacctccctcctcaaaccaacttgcaataa

SEQ ID NO: 478 - DNA, 221 bp, Papaver somniferum
atggtttcatggtttaaatccaaatccaaatttcattcacaatctcaatcaacaaatattgatcatgtaaacccagggtttcttctcacacgtaaactcttcatttggagtgttattgtggggattattactggtttagatagttttctgtttgctgttggttacagttatctacctgtttcagtagcatcactactactggctactcaacttgcttttac

SEQ ID NO: 479 - DNA, 474 bp, Papaver somniferum
atgataaaaacatttctatttggaacgatgtttggcttcaaaactatttcttctttatttcctaacaactctttcatcaatcagagtagtaatatgaaagtcagtgaattgattgtcaatagacaatggatgattcccgaaatggttttggacttcattgatttggctgatcttcctattcttcatcatggggaagacaaaatgatctggtgtggtaattccaagggtatattttctgtttctaatgctctggagaaaataagatttgttatgccaaaagttagccattacatgaaaatttggagctcttatgtgcatcctacagttgccagcaatgtatggaagattgttagaggggctatagctgatgacatgaacatgaaaaagagaggctttaatatgctgtcaagatgcttgttctgccacaaagaggaagacataactgatcatcttttatggcattgtgaagtgtga

SEQ ID NO: 480 - DNA, 465 bp, Papaver somniferum
atgcaaatctttgtcaaaaccctgactggcaagaccattactttggaagttgagagttccgatactattgataatgtcaaggccaagatccaagacaaggaaggtattcctccagaccagcagaggttgatatttgctggaaagcaattggaagatggtcgtactcttgcagactataacatccaaaaggaatccactctccatttggttcttcgactcagaggtggtatgcagatctttgtgaaaacccttactggaaagacaattaccttggaagttgagagttcagataccattgacaatgtaaaagccaagattcaggacaaggaaggtattcctccggaccagcagcgtttgatctttgcaggaaagcaattggaagatggaaggactctagctgattataacattcagaaagaatccactctccaccttgtcctccgtctacgtggtggtgattattga

SEQ ID NO: 481 - DNA, 562 bp, Papaver somniferum
atgcagatttttgttaaaacattaacagggaaaacaattacacttgaggttgagagctctgacaccatcgacaatgtgaaggccaagattcaagacaaggagggaattcctccagaccagcagaggttaatttttgctgggaaacagcttgaagatggtcgaaccctagctgattacaatatccaaaaggaatccaccctgcacctggttcttcgtctgaggggagggatgcaaatctttgtcaagactctaactggcaaaactatcacccttgaggtcgagaattctgatacaattgataatgtgaaagccaagattcaagacaaggagggaattcctccagaccagcagaggttaatttttgctgggaaacagcttgaagatggtcgaacgctagctgattacaatatccaaaaggaatccaccctgcacctggttcttcgtctgaggggagggatgcaaatctttgtcaagactcttacaggcaaaactatcacccttgaggttgagagctctgacaccatcgacaatgtgaaggccaagatccaagacaaggagggaa

SEQ ID NO: 482 - DNA, 216 bp, Papaver somniferum
atgttcttctcttgttcatcaattttctttcgggttcagtcattctatttccatattcgttttacagcaaggctgctacgatgtgcatatgttgatagattaaatccgccaaatggcgacgggtatgactccgatattgatgaaattatggattcaagtgccatgttaggtgatatagatggagtacttggagatatgtttcaagaggtgatatga

SEQ ID NO: 483 - DNA, 1308 bp, Papaver somniferum; identical to SEQ ID NO: 357

SEQ ID NO: 484 - DNA, 633 bp, Papaver somniferum
atggtgattaatcatggtgtggctgagagtctaataaatgaaatgatgaatttatgtctgagtttctttgatttaagtccagatgaaaaatcggactatgttggaaaagatgttttgaatccgatcagatgtggaaccagttttaatacttcagttgagaatgtttacttttggagagattatctcaaggttcttgtacatccagatttccatgccccgctcaaaccaaatgctttcagaaatatctcctatgaatattgtaaaagaacaagagaagtagctaaggaattggttaatgctatatcagagagtttagggcttcaaggagattatattgagaaggcattagaaaccaaatctggtttacaaatcctgattgtaaatctttatcctccttgcccacagccagaacttgctatgggtatgcctccacattctgatcatggacttctcacacttcttgctcaaaacgaaatcggtggattgcaaatcaaacacaaagggaaatggatcgttgcaaatgctttaccaaactcttttatggttaacattggtgatcacatggaggtacgcacattttctcacttaatgccccatttgtgtgattttttcattaactgcatattttgttga

SEQ ID NO: 485 - DNA, 228 bp, Papaver somniferum
atgggtagaactgtcaaggacttgactgaatcaaatgaccttaaaacagttccgtcggagtatgtattccccacaaatcctgaggaagtcgaagaagccgagcaacagattcccataattgattatcacctcctcacatccggttctccagatcaacggtcacaaatcatcgaaaacctccgtattgcatgtctcgattggggtttcttcatggtaatcaaatattga

SEQ ID NO: 486 - DNA, 489 bp, Papaver somniferum
atgggtattatgatcaaagacttgattgaatcaactgatctcatttctgtttctaattccaaacatgcactccctgcaaaagtcgaggatctcactacgttagctgaagaatctgtggagcaagttgctctacccataattgatttctcactcctcacttcgggttccccagaccagcggtctaagatagtcgaagagcttcgaaatgcatgtctgcattggggattcttcatggtggttaatcatggagttccacagagtttgaaagaggaattgatcaactcctgcatgaatttcttcgacttaagtctggaagaaaagtcggtttacgagggagagaatgcgtcagacccttgcattttggacccaattatatgtggaaccaattttaaccctgcctctaagagtgtctccttttggagggattatcttagaattttggtgcatccagtgtttcattcccctcctaaaccagagggtttgaggtga

SEQ ID NO: 487 - DNA, 204 bp, Papaver somniferum; identical to SEQ ID NO: 347

SEQ ID NO: 488 - DNA, 690 bp, Papaver somniferum
atgatgttggaagctgcttgtagatatcagaaagcttttgaaaggctagcacgggaagataaggctttcaaaaagaagttttgtttcaacgaaagatccatccctcctgtattttctacttctaccggtgctagtaatgatgttgacatggaagaagcttctactattgctcataacaaaggcaagaagaaggcccctcctccgcctcctatacatgctccatatatggaagattgggccaatgcaagatcatttggaaaatttttaaaggtattctttgatttgactgtcaagttttcttactgtactcgtgttacttcgcatgagttcttgtttaacgtaagtgtcattcatagaacaatgaacacatgggtaaaaagttcagatccatttctctctggtatgggcactaaaatgctagacaagtttaataagtattggggagaatatgagaaaatgaacactctcatgttcattgctgttttgcttgatccacgtgagaagatgaaaggtttaaattttattcttgatactttagatatcacgggtccgtcattacgtaaacacttatcgacttatgtgaaaactgattttcaagaacttttcgaagagtacaagtgtctctatgcaaatgatgaaaacatgtctggtgatgtttatgattttttgatgttttttcatgatgtgtag

SEQ ID NO: 489 - DNA, 531 bp, Papaver somniferum
atgtctagtgcagcaagtgctggtgataatgtttctcaatcttctggggttactgatgatgaagattccgcgtatgctagtcttatagcagagagagcaagagaagatgaggaggatgacaatgttgaggggaaaactgagttggagttatatttagaggagaaacgtgaaccgagaattagccctaccggtgttcagtttgatattttaggttggtggaggactaattgtacaaggtatcctgtattatcgcacatggcgagagatatactagccataccagtctcttatgttgcctcggaatctgcctttagtactggaaggcgcgttattgatccatatcgaagttcactgctgcctaagacagttgaggcgttgatttgcacgcaaagctggttacggacaccggttgatcttgatttaaacaccttaataactgatgatgccgaagatgtttcagaatgtttaggttctcttgcaacttctaagttcatccgcattgacatagatgatgaagaagaagaagattga

SEQ ID NO: 490 - DNA, 798 bp, Papaver somniferum; identical to SEQ ID NO: 54

SEQ ID NO: 491 - DNA, 602 bp, Papaver somniferum
atgggttggcgtgtttgtattgactataggaaattgaacaaggtcactaggaaggaccactttccccttccctttatcggccaaatgctagagagattagctggacataatcattactgttttttagatgactactcaggctacaatcagatcgttatttccccagaagaccaagaaaaaactacttttacctgtccctttggtacctttgcgtatagacgcatgcctttcgggctatgtaacgcccctgcgacttttcagcgttgcatgatgaacatattttccgatatgatagaaaagtttttagaggtctgtatggatgatttttcagtgtttggttcgtctttcgatgagtgcttgcatcatttgtcattagtgttgagtaggtgtaaggaaaagaatctagtgcttaattgggagaaatgtcatttcatggttcgatcaggaattgttttagggaatatcgtatcttctaagggtatagagctagataaagccaaagttgaccttatcaagactttacaggtcccaaaaaccgtaagagatattaggtcattcttaggacatgcaggtttttatcgtcgattcattaaggattttag

SEQ ID NO: 492 - DNA, 249 bp, Papaver somniferum
atggcaattgaagtagctgaacttttgaatgtgtgttggctggaggtaaatggaaaactcgacatatcaaaactcaacccgggagtaaaatacgaggttgtgttcgtagtaatgttgaaaaattcagcttacggatgggaaaaaccagttaacctcagacttgtacactcaggctcccaaacacaactacgcaaggaagatttacaaaaaaaagccaaagtcacagtggatagaagttcagattggtga

SEQ ID NO: 493 - DNA, 1164 bp, Papaver somniferum
atggcccaatatgctcttttcaaattttctgtttgttttcgttttgattttttgtggatttttttttttacttttcgcctgaaaaagctgaatcttttgcaacaaaataataacacctctgccactctctttcttccgtgctactatttctctctctatatatttcaaaccaaagtttctgaagaaataacaaccagtagtggaagaggaggaaaacttctgaatctctctgatagtattctcatctcattgataaagcacaggcagtttgatttagtaatgatggcaaagaatagtatcccagtattggggcttctactattgtgttgtttcgcgtccattacagaagcaacatacaaatacaaataccaagatcccaaaaaaccactaggtgctagaatcagggacttgatgggtagaatgactttggaggagaagattggacaaatgacacagatcgaaagagctgttgcaactgctgatgtcatgaagaagtatttcattgggagtgtattgagcggaggaggaagtgtgccagctcctcaagccactgctgaagcttgggttaatatggtaaatgagatgcagaagggtgctctctctacccgtctagggattccgatgatttatggaattgatgctgttcacgggcacaataacgtttacaaggcaactatcttcccccacaatgttgggcttggagtgaccagggatccagcacttatcaagaagattggagctgcaactgctctggaagttagagctactggtattccatatgcgtttgctccatgcattgcggtttgcagagacccaagatggggtcggtgttatgagagctatagtgaagatcacaaaatcgtgcagctaatgacagagatcatacctggtttacaaggagaacctcctaaaaattatagaaaaggtgttccgtttgtcgctggaaagaagaatgtggcagcttgtgctaagcactatgtgggtgatggtggcaccactaagggtatcaacgaaaataacaccgtgatcaatgaaaatggattgtacagtattcacatgccagcatactacaattcaatctacaagggtgtttcaactatcatggtttcgtactccagttggaatgggcaaaaaaatgcacgccaacaagaagcttatcactga

SEQ ID NO: 494 - DNA, 1287 bp, Papaver somniferum; identical to SEQ ID NO: 157

SEQ ID NO: 495 - DNA, 897 bp, Papaver somniferum
atgaaagatgagtacaatgctatgttgaaaactaatacgtgggaaattgtaccacgaccacgtgatgctcatgttattcgttccatgtggctatttcgtcacaaatataatgccgatggttctttgcagcgacacaaggctcgtcttgttgctaatggtaaatctcagcaggttggggttgattgttttgaaacgtttagtccggttgttaaacctgctactattcgtactgttcttaccattgctacttcgaggtcttggccaattcatcaactagatgttaagaatgcttttcttcatggtgatctgaccgagacagtttatatgcatcagcctccgggatttgtggatcctgattacgtatgtcgactacgcagatcgctatatggtctcaaacaggcccctcgggcgtggtttcagaggtttcccaagtttattactaattgtggttttcgtggtagtgtgtgtgatccatctctctttgtttataaatccggctcgaatacagcatacttactgttatatgtagatgatattgttttgactgcctctaacaatactctcctacaccgcttcattgatctaatgaaacgggaatttgccatatctgatcttggaccgctacatcactttctgggtattactgtcactcgatcatcttcagggttatatttttctcagtcattatatgctcaggaaatcattgctcgtgcctccatgaaacaatgtaacctagtgtctacttcggtcgacaccaactccaagctcagtgctacttcaggtcctacgattaaggatcctactctatacagaatcctggatggagcattacagtacctcaccttcacccggccagatatttcatatgcagttcaacagattaacaacatactctga

SEQ ID NO: 496 - DNA, 897 bp, Papaver somniferum
atggatagtttttataaaggaatcattttcacaatgggtaaagggaatagaacaaggttttgggaagaccagtggttgggtgatatgcctttgaagatagcttttcccaatctttataatgtctctcggaagaagaacaatgttgtcagccaattttactttcgcgatcaggaagggaattcaaattggaatctggacttgcgaaggagattatcagatgttgagattgcagaggcgggggatctatcgcacaagttacaaaacgtgactttaaatgaagacgaagaccggagaaattggaagtggacagctgatggtgcatttacggtacgttcgtgctatttatctctacttcctccgtcctttttcgttgattttccccacaagattgtttggaataataatgtgccgaccaaaattagtttctttacgtggttggtccatcataattccttactaacacaagataatttagaaaggaaagggagaacgttggtaaatagatgttgtatgtgcaagaaggaattagagattataaatcacttgttccttcattgttcagtagctcactctatttgggatgtatttctaagtggttttggagtgggaagacctcaaggagatgacataaaggatgcttttaaagatagagataggactgatttcacaatgactgggaatttcatttggaacatcctaccttatgttatttgttggaacatctggaaagaacacaatcaacgaatgttcgtcacagaggcaaaagagaaagatgttcaaaaggtcgtactagacattaaggcaaatattttgtattggtctcatccctcaaaggctctccgcgacatcatatttaaaatgttagtcttcaaatgggaagagttaatcaggagatag

SEQ ID NO: 497 - DNA, 453 bp, Papaver somniferum
atgcaacaacagatggcagttgacagctctctctcactgttttctactaaaggaacaactgcctatattgagcaatcaaccccttttcctacagatgggaaacagggatggtggagtggaggatttggatatgggatatggactggggtcttagtagcctccggattttctgttgttccggtgtcttctctcatgtggaagaatcactttgaacttgcaggaagccgtctgagtaaggatgatagcagaaaggctgcatcaacactatttccatctctgagttcccagttgacgaggaagaaagatcatggtcgagctgaggctcttctcattgctgcatatggtaaaggccttgtactgaaatctgaagaacttttcaaacctgaagcccttttaccaaaatccgaagaatgtcttttagagtcggatgccattttaatgaaagctggataa

SEQ ID NO: 498 - DNA, 1587 bp, Papaver somniferum
atggttcatcacctggatagcggcggcctacctaaagagagagtcttgagatttgcattcttaaattcttacttcaaaaccgaactaagaaatccggtagatgaagcaattctagcttatgtctattcaaatggatacagattcgaacaatcaaagtggaaaaagatagatgagactcctttcgactttacaagaagacgagtctctgttatcattgaagcagattcagaaacaacagatagaatttaccctcatcttggtactaataagctcgtggtcactaaaggcgcacttgaagaagtgttacaggtttgcagtttctatgaccatgctgatagtggttcaagcataccactccctgtagaagatcagcataagatcctgcatatgggagaagaactaagcaatgatggactaagggttcttggagtggctatacgaagactagcaatggtgggagaagcgaacagtgtggaatcaaatatggttttcctaggcatcgtaaccttctatgaccctcccaagagctcagcgaaggaagccttaaggaggttggcggaaaagggtgtagaggcgaaagtattaactggagactcagtctccttggctataagagtctgcaaagaggtaggaattagaaccacttatgcatccacaggaccagacctcgaactcttagacccttcaacctttcatgagacagttcagagggctacggtattagctcgactgaccccgacacaaaaattccgcgtggttcagtcactgcagacagctggagatcacgtcgtagggttcttgggagatggagtaaatgactctcttgcaatggatgctgcagatgttgggatatcagttgattcaggtgtatctgtggccaaagaccttgctgacattatactactggagaaagacttaaacgttttagtctccggtgtagagcgaggaagaattacttatgggaacacaatgaagtatataaagttatcggtggtggcaaatgtgggcagtgttgtgtcaattctaattgcagttctgctccttggatacgagcccttgacagcaaggcaactcgttgttcagaattttttatacaatgtcggccagattgccattccttgggacacggtggaagaagactatgcaaagttccctcagcggtggtcatcaaaaagcatacctatgttcatgctctggaacggaccagtttgctccatgtttgatctagggtatcttgtgttcctttggttctactacgaattataccatccttcctccggagataagctctaccatactggatggtttgttgaagggcttctcatgcaaacccttataatccatatgatccgaacagagaaaattccgttcattcaggaagtagcgtcatggccagtgatctgctctactgttttgatatctgctgtagggattgcattgccgtatactccgataggaaaagtaatgggaatgactgacctgccattgtcctattttggtttcctagttgtgctttttcttggttatttttttcttagccaggtggtcaagagagtctacattaggacttataaagaatggctctaa

SEQ ID NO: 499 - DNA, 498 bp, Papaver somniferum
cttcatgcagttaatggttcccaaaatggatgggatcacagtgcaggtcgagatggttctgtgggctggccaacatctaatgaacacatccagcaaagccttgatgcgatagaattcatagcttccaaatatggaagcaatcctactttattggggattcaacttttgaatgaaccaaaagctcctgaagttccgctcaataccttactggattactacccaaagggatacaatattgtcaggaaatattcagctacagcttatgtaataatgtgtcagttgattggcgcagacccatcagagctttatcatgctattgcgaacatgggtttatcaaacgtagtggtggatgtacatttctacaatttctatcaatcaaaatttgatacgatgagccccgcagagaatattcaattcgtcaaagagagcaggaaagctcaagtagattccctaaacagtgctaatcgagatggtccattggtttttattgaaaaatga

SEQ ID NO: 500 - DNA, 1827 bp, Papaver somniferum
atgccggaagctccagcgaatgacacagcgtcggagtatgttgtggttgacaagagtaagatagcacttgaattcatcgaaaatgtcacaacaaatgctgatgaagttcaaaagaaagtgcttggtgaaattctttcccgaagttctcatgtcgagtacttacagagatacgatctcaagggacgtgtcgatcgtgagacttttaagaagattattcctgtcataacttatgaagatcttcaacctgatatcaatcgtattgctaatggtgatacttctcctattctctgtggacaacccatttctgaattcttgactagttctgggacttcagcaggagaaagaaaaataatgccaacaattgaagaagaattaaacagaagatctctactttacagtctcttaatgccagtgatgaatgaatatgttcctggtcttgataaaggcaaaggaatgtattttctgttcatcaagtctgaagctaaaacaccaagtggattggttgctagaccagttctaaccagttactacaagagctcacatttcaaaaacagaccttatgatccatacaccaattacaccagcccaaatgaaaccattctctgtccagattcttaccaaagcatgtattcccaattactctgtggtctttaccaaaacaaagaagttcttcgagttggtgctgttttcgcttccgggttcatccgagcaattcgattccttgaaaaacattggacttctctctgtaatgatatccgaaacggaaccattgattcccaaattactgatccatctgtgagagaagctgttctggcaatactcaaaccaaacccaaaactagctgattttattcaagaggaatgcagcaaggattcatggaaagggatcataaccaggttatggcctaatactaagtatattgatgttatagttactggaactatgtctcagtatattccaactctgaattactacagtaacggcctaccattagtttgtaccatgtatgcatcttctgagtgctacttcggtttgaaccttcaacctctttgtgatcctagtgaagtttcttatacactcattcctaccatggcctacttcgagtttttgcctgctcatagaaacaatggagttagcactaaaccaaaatctctcactgagaaggagcggaaggaattggttgaccttgttgatgtcaaactcggtcaagaatatgagcttattgtcaccacctacgccggtctttaccgctacagagttggcgatgttcttagagttactgggttcaagaacaaggcaccacaattcagctttgtttgccggaaaaatgttgttctaagtatcgattctgataaaaccgatgaggtcgagttgcaaaacgcggtgataaatgctgttaatcatctagttccatttgattcgtctctagttgagtacacaagctatgctgacacttcaactatcccggggcactacgttttatactgggaacttcgccacgatggtacaactccaattcctccatcagttttcgaagattgttgtctaacaatggaagaatctctcaacagcgtttaccgtcaaggccgtgtttccgacaaatcaattgggcctttagaaataaagatcgtcgagtctggaactttcgataaactcatggattatgccattagccgcggcgcgtcgataaaccagtataaaacacctcgctgtgttaaatttcaacccattgttgagctcatgaattcaagggtggtcgagagttatttcagtcctaaatgcccaaaatggatcgttggccttcagcaatggcgcaaccaaaactga

SEQ ID NO: 501 - DNA, 1431 bp, Papaver somniferum
atggcagatgaataccaaagttcaggaggaatttgtagtggaaattggtggaataatatgaagattggattatcatcatcatcatcaccagcatgttcaactactcttactgatattggaagctacaacaattggcctattagtactattactgatgatcaaacagttgatatgaaatatcctaaacttaatcatcaagctgcatcaccatctgatacttccgttattgctggtaccaatgatgttttacttgataataattctaattcacagatgatgggttttgatctttcatcacccttaacaacttctgattggtcccaacccttactcagtagtagaagtagcgaagatcatcagcaaaaggagtggagtcctaaaaattgctctggtagtagtggcggtgaagattcatcatcaattcattcttcatttaagcaacaacaaataaatcagggtttcagtttagacccacagtactgttacagctctaacaaaattgacaacagcgacagctgcacaggaggtctacccatgagtttttctatgaattcagcttcatatgaatgtagcccatcaacatctacgttattacacagtttatatgagcctgagaatcatatggaacaacttcaacgatcatcttacgatgaggataatcggatgagttatcccagttctacgacgtccacgaattaccaactgaatccaaatgagttatctccttctcatccaaattggtcatcaaaattccctcagtttcttaaaactgcagtttcatccagacaacaacctagtaatactaacattaacaatcatttgcaattctccaataactctcagttttggaacccttctcctactagcatattaactggcgataacccttctcgtcttctctcttcgccacaaactcaatttttaactcccacactcaatgatcatcagaaacctaattccaacaatagcctctgcttgaagccaagcatagaagaagttcaagattcaagctcagtagcgaaaaaaaataagagtagcgaacccgcttacaaaaggcctcgaatggaaacaccatcacaattaccaacgtttaaggttcgaaaagagaagttaggagaccggattaccgcactacagcaattgtgttctccttttgggaagactgataccgcatcagtgctttatgaagccatcgagtacatcaagttcctccatgatcaagttacagttcttagtaatccgtatatgaaacatggatcagctcccatgcagtaccaacagaatatggacaattccaaggatggagagagaacaagacaagatctaagaagccgaggtttatgtttggttccaatgtcgagcaccttctcagttactaacgagactagtacagatttttggacaccaactttcggaggaacttacaggtag

SEQ ID NO: 502 - DNA, 976 bp, Papaver somniferum
atgcttacagctattcctacggcagatgaaattcgaaatattgtttttcaaataaaatcttgggctgcatcgggtccagatgggtttcaagcggggttctataagcattgttgggatgtggtggggcctgatgttgttttaatggttcaagagctttttactaccggtattttactgccaaaacttaactatacctatcaaactttaattcccaagcatgattctgctcatacaccatccgatttccgtcccataagtttatgtaatatcacttacaagatcatatctaagttgatggcggttagattgaagactcttcttgcaaaaatagtttcgccatggcaggcagcttatgttccaggccgtaacattatggataataccattattgcgcatgaaatggtggactacatgaaaaaaacaaaggtttttcctggggttatcgctattaaattggatatggctaaagcttttgatcgtatggaatggaattttgttatccaagtcatgcagagtctggggtttaatgatcgttggtgttctctgatatttcaatgtattagtacctctactgtttctttgatgctcaacggttcaccaacaacaagttttactcctacccgtggtcccatttcaccttatttatttatattatgtatggttggttttagtcacatcatttcacatggtgtttcgtcaaatcttattcttccagtgaaaccagcaattcatgctcctcatatttcccatttattttttgcggatgattgcattttgtttactcgagcttcgggttcctctatcacaaatttgctgcaaattataaatcgcttttgtgctacttctggtcaacttgtcaatttcaataagtctagtattcattttagttctaagttgagtgattctgctaaagctgatatttgtcatatgctgcaaatgaaacctatgcctcttcatgagaagtatttgggtgtta

SEQ ID NO: 503 - DNA, 1827 bp, Papaver somniferum
atgccggaagctccagcgaatgacacagcgtcggagtatgttgtggttgacaagagtaagatagcacttgaattcatcgaaaatgtcacaacaaatgctgatgaagttcaaaagaaagtgcttggtgaaattctttcccgaagttctcatgtcgagtacttacagagatacgatctcaagggacgtgtcgatcgtgagacttttaagaagattattcctgtcataacttatgaagatcttcaacctgatatcaatcgtattgctaatggtgatacttctcctattctctgtggacaacccatttctgaattcttgactagttctgggacttcagcaggagaaagaaaaataatgccaacaattgaagaagaattaaacagaagatctctactttacagtctcttaatgccagtaatgaatgaatatgttcccggtcttgacaaaggcaaaggaatgtattttctgttcatcaagtctgaagctaaaacaccaagtggattggttgctagaccagttctaaccagttactacaagagctcacatttcaaaaacagaccttatgatccatacaccaattacaccagcccaaatgaaaccattctctgtccagattcttaccaaagcatgtattcccaattactctgtggtctttaccaaaacaaagaagttcttcgagttggtgctgttttcgcttccgggttcatccgagcaattcgattccttgaaaaacattggacttctctctgtaatgatatccgaaacggaaccattgattcccaaattactgatccatctgtgagagaagctgttctggcaatactcaaaccaaacccaaaactagctgattttattcaagaggaatgcagcaaggattcatggaaagggatcataaccaggttatggcctaatactaagtatattgatgttatagttactggaactatgtctcagtatattccaactctgaattactacagtaacggcctaccattagtttgtaccatgtatgcatcttctgagtgctacttcggtttgaaccttcaacctctttgtgatcctagtgaagtttcttatacactcattcctaccatggcctacttcgagtttttgcctgctcatagaaacaatggagttagcactaaaccaaaatctctcactgagaaggagcggaaggaattggttgaccttgttgatgtcaaactcggtcaagaatatgagcttattgtcaccacctacgccggtctttaccgctacagagttggcgatgttcttagagttactgggttcaagaacaaggcaccacaattcagctttgtctgccgaaaaaatgttgttctaagtatcgattctgataaaaccgatgaggtcgagttgcaaaacgcggtgataaatgctgttaatcatctagttccattcgattcatctctagttgagtacacaagttatgctgacacatcaactatcccggggcactacgttttatactgggaacttcgccacgatggtacaactccaattcctccatcagttttcgaagattgttgtctaacaatggaagaatctctcaacagcgtctaccgtcaaggccgtgtctcggacaaatcaattggacctttagaaataaagattgtcgagtctggaactttcgataaactcatggattatgccattagccgcggcgcttcgataaatcagtacaaaacacctcgctgtgttaaatttcaacccattgttgagctcatgaattcaagggtggtcgagagttatttcagtcctaaatgcccaaaatggatcgttggccttcagcaatggcgcaaccaaaactga

SEQ ID NO: 504 - DNA, 339 bp, Papaver somniferum
atgccaatgttcaacaagtatttggaaaaaggtttgcagaatgtcagagattaccaggttttgtccgtatctgtggaggttgtcggtgatatgtgccgtgctttggatgacaagatcctacccttctgcgatggtatcatgtcccgtcttctcactggcttgtccactggtgtaatgcatccatctatgactcccttaatattttcctgttttggagattttgggattgcaattggtaagcactttgaaaagtatctcccctatgccatgccaatgattcaagtggcttctaagatttgtgctgagatggagcaaccagctgaggtgtggtatctttga

SEQ ID NO: 505 - DNA, 1140 bp, Papaver somniferum
atggagggaacttctgttggaacaccgtctagggtttcactcctcaacgcttcagctttaaaatgtagaaacaatttcatggttacaaggtcaattccaggatatcttttcgagaacacgaggaggaggaatgattcaattaagcgtgttctatctcaggagtcggagggtggagcttctgtagcttcttcttcttccagtagttcggtagacgaccaaggtatcaaaatcagaagacggccaacatctggacctccttcgcatgctgtgggtccttttgagtttagattacagaatgacggcaatactcctcgaaacattctggaggaaattatatggaacaaagatgtagaaattacacagctcaaagagaagaagcctctttattcgttgaagaaagcgcttgatagtgctcctcctgtgagggattttgttggagctttaagatcagcttatttgcgaactggtgcaccggctttgattgctgaagtgaagaaggcttctcctagcagaggagttctgagggaggattttcatccggtcaatatagctcaagcttatgagaatggtggagctgcatgcctcagtgtattaactgacgagaaatactttcagggaagcttcgagaatctggcggcaatacgtcgttctggaattaagtgtcctcttctctgcaaagagtttataattgatgcgtggcaaatttactatgctcggactaaaggggcagatgcaattcttctgattgcctcgatattgccggatgctgacatcaactacatgagtaagattgccaaaaagtttgggttgtcaacactagttgaggtacacaatgaatcagaaatggatcgtgtactaagaatcgatgggattgaccttattgggattaacaaccgaaacctagaaacatttgaggttgatatcagtaacaccaaaaagctccttgagggaaaacgaggtgaaataatccgccaaaaggatattattgtggttggggaatctggattgtttactccagatgacatagcctatgttcaagaagccggagttaaagcagttttggttggagaatcacttgtcaaacaaagtgatccaggaagggggatagctgatctttatggtagaaatatttcttcctaa

SEQ ID NO: 506 - protein, 399 aa, Papaver somniferum
MKGHDNSMTMLLVDFSNAFNLVDRSTLIREGRHRCPSIASWIEFCYSSPARLYYNDVVLSSAQGVQQGDPLGPLLFALALHPIAENITTQCSLDLHAWYLDDGTIVGDTMEVSKALKIIQTNGPARGLHVNVTKTEVFWPSLDLRRDLEDVFPVNIGKSSRGVKLLGGPVSLDMQYCSEVVQGRVDKTLHLWEKVQKLYDPQSELLLLRSCSGVSKLYFTLQTTAPLDIQSSAIHYDSQLMLYLRQLVVGDSAGFGLLQRRLATLPIKDGGFGIYTLNDTCQYCFLASCAQNQHLQQSILKQSSVLDPSFRFKHALQSFTQVCGLSVSGFSINDAAPQYMKTLAVIYFGAVKERIPTNFSLTDRDLTLWHCNRTPHAMDFLKAIPIHGINQAIAPRQFR

SEQ ID NO: 507 - protein, 481 aa, Papaver somniferum
MAVALRSKSIKEATLRTIVTRSRYFVFDHIHKIGGISNIHYTTRRKQWVDYLAKTFYCLNSFKSASLKAEFIDKGNIISTSNVKVNTDNREVGSSDCDENRVKQSEFLGEFWSYSEPPEIWQPNGEGNVVHWVPPNGKHGGGSGGGGGPDCGGQMGSNSKNGCWGGANMGKEIPSPKEICKGLDKFVIGQQHAKKVLSVAVYNHYKRIYCESSQTRIWSDRSARDSGDEADETDFDSVDLEKSNVLLLGPTGSGKTLLAKTLARFVNVPFVIADATTLTQAGYVGEDVESILHKLLVVADYNVAAAQQGIVYIDEVDKITKKAESLNNSRDVSGEGVQQALLKMLEGTIINVPEKGARKHPRGDNIQIDTKDILFICGGAFTGLEKTISERQHDSSIGFGEPVRANMRSGGVIDATVTSHLLETVESSDLVAYGLIPEFVGRFPVLVSLSALNEDQLIQVLTEPKKCPRKAIQKDVSNEQC

SEQ ID NO: 508 - protein, 453 aa, Papaver somniferum
MNASECSLSTRVLYPQCNINRPRTNISSISFPNQSKQFHFIRRKHPLLLRSFGVIRNASSETPSESDTTSKPSGDDFITRVLKENPSLVEPKYLVGNKLYTLREKEILSNKVPNERILEIAKQFCVKLGFKKDEMGDGNQQFSDSVYLKDLLREYKGKLYVPEDVFHENLSEEEEFKRDLENLPQMSFEEFQKVFKTGKVKLLTSKADSGISYKYAYKDFIVDLKEIPGDKNLQRTRWAMRLNENEAKSVFEQFKGPQYEIEQHLTSYTGRLPEYPHPVASSISSRMMVELGMLTAVMATAATIVGGFLASAVFAVTSFLFFMAVYVLWPLAKPILKLSIGLISAVGERIWDNVIDTVSEGGIFSKLSEFYTFGGLSSSLEMMKPISLVFLTMALLIRFTLSRRPKNFKKWDIWQGIEFGQSKPQARVDGSTGVSFNDVAGIEEAVEELQEVH

SEQ ID NO: 509 - protein, 655 aa, Papaver somniferum
MEEDSDGRSGKARMLIEKATNSVEPEVNPRLVKAIKFVVRSSDSEIKLAVETLMENMKKNHSQVRYLALFIVDELFMRSKLFRSLFVVKFDLFLSLSIGFRRDLPLPAPAPIATRLRSKATEFLEKWNTSFGLHYRQIRLGFDYLKNTLNFQFPNLQANAARIQQERREREIRSKEILLKKFETLSQNLSSIKDEIQITVEEIRQCLDILRTNEADDIMLDTPEEDEVEDFRCSSLMEIRLESLRESEKLRETSENKVIFDALRELYKLLITKHLVSVQEWISVLIRVEPEDTSFRDSMLREFIDLQNHLKSVRKTCENSGCALTDSKNDKEEDFWEEGKVEVCGYGSSSTPAKANKDAACMSAVITKSNITPRQITDSNASKRLDGEGEDSESNPLRRKLLSEAPVVNWGSSLSNWGSNWDVLANQRGLELEGHWGRVDYDAVIPAEKIAELNVQASVYKEEHVDIQPCLAPLRKGGVCQRRDLKICPFHGPVIPRDAEGNPINQVSLAEKEITKMETEEVIARQLAEQAVKNVREREKDEVKKRVTDRKLLSRAKLAKVREHNEVVLRDAAVASTSRSAFVGQDGETQHQTTRSSIKGKKPSLASMLRKKVTSKDRLSQRLLNTRATDATVRQLTVGEDSKYREAYPNQWKRT

SEQ ID NO: 510 - protein, 168 aa, Papaver somniferum
MDQMGYIDQGFRGDPFTWTKNQQGHDNIQQRLDRAVTNQHWRTTNPHAGITHLPRIASDHAPILLQTKALDWQGSKNYKFEHLWLSHPQLHQVVTSAWDKLHDSDPPLNLQLKLISASETLTEWNKINFGHLPTLIKKSTAKIKASQHQCATQTGAALENWIQQEKQL

SEQ ID NO: 511 - protein, 520 aa, Papaver somniferum
MAFSYTCLGGATLRTLKFSSCSSILRPSLPLLSPPAKTLTLHSLHHLTKTHKFPPFLTRAVSVPAGQTLDKEETAKPYQWKATIDFKWIRDNKDAVASNIKTRNSVADLDLVLDLYERSLNLQKEVQRLRGERNVVANKMKGKLEPSERQELIEEGKILKEGLLTLEENLLKLTEKLQKEAQCIPNMAHPDVPIGGEDCCGLRKTVGSPRQFDFPVKDHVQLGKELDLFDFDAASEVSGSKFYYLKNEAVMLEMGLTNWAIAETMKRGFTPLTTPEIVRSSLVEKCGFQPRGSNTQVYSIEDSDQCLIGTAEIPVGGIHMDSILADSQLPLKYVAYSHCFRTEAGAAGSATRGLYRVHQFSKVEMFILCRPEDSDSFHQELIEIEEDLFSSLGLHFKTLDMATGDLGAPAYRKFDVEAWMPGLGRYGEISSASNCTDYQSRRLGIRFRPSTEQTSSNSKKGKANVGTTQFVHTLNATACAVPRMIVCLLENFQQEDGSVVIPEPLRPFMGGLDQIRPKGQ

SEQ ID NO: 512 - protein, 281 aa, Papaver somniferum
MANSLLQSSSVLLSKFSSSSPSSTSSCSASLPCINIPSKSSIVQRKRSVVLRAASIEKALNDLPADVDKVIDGVEKALTPTSEIKVKLLSIVAGLNKGLAANGEDMEKADAAAKELEAAGGTVDISEDQEKLQGRWKLVYSSGFSSRTLGGSRPGPPIGRLLPITLGQVFQRIDVFSKDFDNIVELQLGAPWPLPPIEATATLEHKFELTGSNKLKIVFERTTVKTTGNLAQLPLLEVPRIPDAFRPSSRTGSGEFEITYLDADTRITRGDRGELRVFVKA

SEQ ID NO: 513 - protein, 920 aa, Papaver somniferum
ANLEIVLLSSNQFIGSISKNIGNMTNLSSLWLNSNKLSGSVPYSVGSCTKLTEIYLKDNNFTGVLPKSLSNLKLLNVFDVGSNSLEGGISEGFGGSNCKTLSTLDLSSNRFDGEIPNQLGNCTSLQVFSVADNKLTGGIPSSIGLMTELTELYLSVNNLSGKIPTEIGKCRSLTVFEASYNQLEGEIPSELGLCSKLQTLFLYVNMLTGEIPLSIWRIQTLENVIVYSNSLSGELPVVMTELLHLKNISLFNNHFSGIIPEKLGINSSLLELDFVNNSFSGEIPPNLCFGRQLQILNLGLNQLHGYIPSDVGSCSTLDRLNLKQNNLTGLLPDFVENSSLSFMDIRGNNFSGKLPSSLGNLIKLQVLDLSGNNLQGSLRQQISKCTKLYYLDVGFNKLSGPIPSGLRSLTLLSNLKLQENQLNGEIPDFFPEFEHLLELQLGGNLFGGSIPRSFGRLHDSVYALNLCRNALTGKIPVELGKLRKLQKLDISVNNMTGSVAPIGELLSLIELNVSYNSFSGQISQTLMKFLNSSPTSFLGNPGLCVPCPLGSGVACTESNNSLGICDDRSRSRNNLSKVRIVIIAISSVFVVIVVVLVLGCMFLSKRKQEMKDEVSDEDDQSPLISKIMKATENLSERFVIGRGAHGIVYKASISEENHYAVKKLDFVGLKGASASMIREIETVGQIRHRNLVRLEEICMRKDYGLILYRYMQNGSLYDVLHEISPTPDITWDIRYKIALGTAEGLCYLHQDCHPAIVHRDIKPNNILLDSEMEAHISDFGIAKLMDQSSASIQSISIAGTTGYIAPESAYTMIRKPESDVYSYGVVLLELISRKKALDASFPEGIDIVRWVNSTWSSQKSIDIIVDSSLLDEIVVSSLTEEVTKVLLLALQCTRTDPNERPTMREVVKQLEDANTRWETK

SEQ ID NO: 514 - protein, 620 aa, Papaver somniferum
MGSKKRSSESSSDDEIMEESEDLILTSDDDDSGDEQEEPKSITPKPKKKSLETKEDVAEPSPAAPVSVKPMERRKKRKQMDKERHKTEEKKVKVPKVQANTDAAVASSSSSKPVFHISVFNDLASVGSSIREAATETLVKELRDVQKEYNLVEKKGGDDGSQLEAEKKDGLDNCASSLRYAIRRLIRGVSSSRECARQGFALGLTVVLKTIPDVKLDALMKLITDILEVNSSMKGQEAKDCLLGRLFAYGAVTRSGRVAEEWISNNDTPCVKEFTSLVIALASKKRYLREPAVSLILDLAEKLPVVALSSHVVEAPGMMEWFKHAMEVGNPEALLLALKLREKISSDIDVFGGLLPQPFSPNKMFTAEHLNSLVPCFKESTFCQPRIHSLWSVLINVLLPDTLTQEEDVTSSSSSSKKHKKSRKSSSSEEEVVKNLRCFCEIVIEGSLLLSSHDRKNLAFSIVLLLLPRLPASCIQIVFSHKLVHCLMDILSTQGSWLYKSAQCFLKEIADWVKNDDDRRIAVIVALQKHSNGRFDCITRTRTVKDLVGEFNSESGCMVFVQNLVSMFVDEGAASEEPSDQSQTTDDNSDMGSIEDRDSALMGDQDSLKSWVVDSLPRVI

SEQ ID NO: 515 - protein, 323 aa, Papaver somniferum
MFTKTKKCCSPHEKSYPQNNQAVGATILILITMLFIATSATTSIPISSSSPSSSSMIRFQKPLSQLRRSIKFHYPLISPKHLTKSLPCPLWSSSFSFCLQQLHTSSPSSLSRSSFSAAAPFCTFSPLMDSQNPSPVVSSPQEEVVELKDNPLLKDFDFPPFDVVEAKHVRPAIRAILSELETELVELEKSVEPTWPKLVDPLEKLVDRLQVVWGVVNHLKSVKDSADLRSAIEEVQPEKVKFNLRLGQSKPIYNAFKAIRESSDWQTLSDARKRIVEGQLKEAVLNGVSLEDDKREQFNKVQQELEKLSQKFEENVLDATKKV

SEQ ID NO: 516 - protein, 192 aa, Papaver somniferum
GVLYHQNPDGSLSRCLGDEEAQLQLSRIHNEICGQTLVVTLYRRLQRLGFYWPDMETQYRSLQGYYSNCQIPPHQLEVFNVNHTGDWRKPYVNYLRDGVLLASKKDAAKMKQRAKRFVFHGGIQYRKSFGGDLLRCLAEVEIPILMKEMHEGEHRGRKKLFLEDDTAAFFKDATNVKCTEILFMHFLLLYTR

SEQ ID NO: 517 - protein, 176 aa, Papaver somniferum
MRTGVTIIHRSLSTSSSAQSLSPSIAAAPIHSPWHSPIPYLFGGLAAMLGLIAFALLILACSYWKLSAFLDNDSERSRNDLENGDGDDKSTDQENIKVHVVYEEKIVVIMAGDVKPTYLATPIDYPKPNTTSENSKNEDEMMNSLDEKTKEEESDVRVETESREAIQNPHQHHQNH

SEQ ID NO: 518 - protein, 473 aa, Papaver somniferum
QDLNENERVSVEGILDNAVTQLKMVQSHMKKTLAESTSAPSLNFGAKQQDGKMEDIVCRKCGKFKKLKTVGAVVITELDVIRRLKAGCNTGGNQVLSQDRDEILSRAVWRKFQTHQRTTSPPLLVPKVGFGGSEEMISCPRREQKYRPTDGVMQPTLMKFGPSGVEAYPDQDRTANSRSHRNIESTGYSATSEASFSSADYSESYSSSEESDSPPQHAMHLDRRRRDRSISRSRSPQSRYSGSSRSYTSYDAYDSYPEEEYPVAYNYDSYDSSPEEYPVARGNRSYTSYDSYNSSPEEEYPVARRSRFPKNDPPQKKMGHVRRLTTKLGGMLRRDHHGDSSKDDKNARDHHPSVQKPVGNGKLHHEIKGKHMPIQTRRTAKVEEKASHQQGFLTLAKRVRGHVFGSKKSKPSSSGVRRLERAVTGKEKVTAKKRHWWHKLRRQGLPNKRGKAPLKLGFENKHTQLKGQHRHRK

SEQ ID NO: 519 - protein, 174 aa, Papaver somniferum
MFATICNNNYESLVLGEDINHFAGLRTIRLRRRFYISLLPQQLVHIPSSASVPSGPSPHSYLLRRVFSLPTRDDDCEEILGSYLRRVLRLPTRDGKLSELLRSKTWLLLWVVFQGELVTLAFTFYHSRKSVLPHLQQAADAGFKTKLGGQYNQAVSHHQQTTEPPNQVVQRVTM

SEQ ID NO: 520 - protein, 217 aa, Papaver somniferum
MGMVFGKISVETAKYEVVQSSEDYEIRKYTPCVVAEVAYDPSKFGGDRDGGFMVLANYIGAAGNPQNTKPEKIAMTAPVITTQKASEKIAMTAPVITTQRTPETVDTHQEKTTPTSMVMQFVLPTSKYTSVEQAPKPTDERVVIREEGERKYAVVKFSGLTTDQLVEEKVKKLMESLERDGCKVITRENEDKFLLARYNPPWTLPMFRTNEIMIPVE

SEQ ID NO: 521 - protein, 103 aa, Papaver somniferum
TSIIDSNQMKPFEHILSSYFSDHQLHHHKHTICNFNITIPDNINSMFMFLKCSTTRTSSHTNTSSISISRPTRCSLTDGINSICIFFLTPLRFLYLVQRFQFF

SEQ ID NO: 522 - protein, 243 aa, Papaver somniferum
MNLAMLANWCWRFGQEKNRLWYRIIVDKYGDNFSIWIPNQVKSAHGVSCWKTIATTAYLVSTNSRLIIHSGATMSFWNDIWRGNSSISSSFPALYKISTNRDAKMVEMISMDGSWMFSFKRNLSGSEANSFAELLMMIGNNPPALDDLPDTRRWSLRNSGIFTVKSLYSKLIADYGVHDFPHNFVWKKLIPPKINFLVWCLIHEKLNTIDMMQIKGIDIYNSCVLCGDDIESGSHLPALQNSS

SEQ ID NO: 523 - protein, 907 aa, Papaver somniferum
MEQLRPNPLIRRFDHSTSNNFYSPRNVRRKTFNERVDNTEALFTSKSLTEGKYRYRRGDVSDIIDYSVPSMTEQLDGDSMYGSVTKVIQALSAKRCEILNSLRELYPSLLSHLVFSVGTPPRGSRGTSNVVSQGVIDLDGEDEIHDLGPVSDERMETPAGQIVLHTPGCNNAMVMAGSESDDRYMIGNNKPDYSYDLEVSKMRRDPNYCGIQISTDAQRIGSQVRTPYHVEQRQRRNSTTQNDNQGIAPVGAQMSTPYDFQLLFPKKPVGEKPAKHVNGSDQRKRNVEKEDKGVCGETVIEKSKGVYVGVQDDIMSDSGSGGEDDGLGDIWTEMNLALECSKDASSALGTAMEHIAEEEEEDECEHSFVLKDDLGYVCRICGVIEKSIEQIFDFQWGKGTKTTRTSYMSQYRTTKDCERVEGSQFTIANASDQDFGVAEISVHPRHMKQMKPHQIEGFNFLLRNLVCDSPGGCILAHAPGSGKTFMIISFMQSFLAKYPNARPLVVLPKGILGTWKREFERWQVEEIPLYDLYTSKADSRAQQLDVLKQWVEHKGILFLGYKQFASIVSNSTSSIAAAACHDILLKVPTILILDEGHTPRNETTDVLYSLSQVQTPRKVVLSGTLFQNHVKEVFNILNLVRPKFLKLDTSKAVVRRVMSRVQIAVRKQVKNSGGDTMFYDLVEETLQNDQDFRRKVTVIQDLREMTGKVLHYYKGDFLDELPGLIDLTVLLTLNPKQKHAVEKLRKLDKFKRSSMGSAVYVHPQLKEHAESSATGEKGHIHEAKIDELLNKVELNDGVKTKFFLTLLALCESAGEKMLVFSQYLLPLKFLERLVVKTRGWSLGKEIFVISGDSSQDQREISMERFNNSKDAKVFFGSIKACGEGISLVGASRLLILDIHLNPSVTRQ

SEQ ID NO: 524 - protein, 144 aa, Papaver somniferum
MNPDDYSYMHHSPQRENEHFASASLTQSSLVDQLEARIAALEMQSHEESVTSNFLRQPEIYACPACGSLDHPVEHCHILHNFRQSRENPRYEMPINCENGSHWDHNQSFEGCDQSFINPNDHAHMYHSPQFEHEEFCTPRNLDS

SEQ ID NO: 525 - protein, 183 aa, Papaver somniferum
MNPNDYSHMHHLPQRENEHFANASLTQSSLVDQLEARIAALEMQSHEESVTSNFLRQPEIYACPACGSLDHPVENCHILHNFRQSRENPRYEMPINCENGSHWDHNQSFEGCDQYFVNPNDHARMYHSPQFEHEEFCTPMNLDSTTEALRLSKQKFDRSTSRIHAYLDQILLHLQKEEIHEEM

SEQ ID NO: 526 - protein, 247 aa, Papaver somniferum
MVNWMLIIPCTIDSTTSENRNLRFTCYETDNNVKDTCEYDGFIVVFDRTKLSSYKYAKNICHQLAARLVGYKPVVLVANKIDRFQESRKAYEIAADQEFGHPSCFISAMNNTNVEKPCLSLARLLTNVPRLIFLHDMPIAGKVPGGNIEDPPIPVDIPIAPSLSTVLMLGSSAYDQVPAQPSQQIQTTLKVLGDTPDAPLPSTVRHLDRTPEVSSRQSRKSTLRINGVDCASVSEILEDQRSKCCYC

SEQ ID NO: 527 - protein, 177 aa, Papaver somniferum
MASSQKSVCIINSSLLVPFFLHLLLLLTSTEARHLKHRDSNSTGNVQEALLNGDIKVSGPSPGGEGHSFKNVVQTMGGNKVAGPSRGGEGHKFKTQQLRTFGRIKVSGPSPGQGHKFKTQQLQTIGRIKVSGPSPGEGHNFKNVVQTMGGNKVSGPSPRGGGGHHNSVTKIHKSKRD

SEQ ID NO: 528 - protein, 137 aa, Papaver somniferum
MQFLKLIHRAEKKLESIIGVIEANRIEGEITSKNSSIQSEKEDESLDEFIIPSFLFYEENDDTQIISKTEVIDFDRENHVQMVEVSYENLESIRELIIIHSELNCKDFFTLLFDFARSLFDRGKKIELSLENSCFTD

SEQ ID NO: 529 - protein, 151 aa, Papaver somniferum
MPSQHAITEYRLVQSSVQGLTWIELSPLTGRKHQLRVHCAEVLGTPIVGDYKYGWQAHKNWKGLPWTNPKERSAEKLPKMPLFVLDSKSGSISEKEPHLHLHCRQMIFPDVHMALQHVHSDSDLDLSTLESLDFVAPLPAHMQRSWDILNS

SEQ ID NO: 530 - protein, 247 aa, Papaver somniferum
MLPTTSKGRASNVRPNPVFPQYLRRIVKWRQMDIEYTFWQMLNLCTSPKVVYQHTKYHKQTKNQWARDDPAFIVICSLLLIVATSAYCAAFSHSVGHAISTVLSVLIFHFLITGAILATCCWFLTNSYLREESPNSHVVEQRVEWLYAFDVHCNSFFPMFVLLHVIHYFLSPLLIAHGFIPVLLSNLLFMVAVSYYHYLNFLGYDVLPFLERTTFFLYPIGIVIILSPLMILSGFNPTRYMMSMYFS

SEQ ID NO: 531 - protein, 357 aa, Papaver somniferum
MGSVGSERTTTGWAATDPSGILSPYTFALRETGPEDVYIKVTYCGVCHTDIHQVKNDLGMSNYPMVPGHETVGEVIEVGKDVTKFKAGDSVGVGLIIGSCRECSSCTSNIEQYCNKKIWNYNDVYTDGKPTQGGFASTMVIDQKFVVKIPEGLAPEQAAPLLCAGLTVYSPLRKFDLTTSGLKAGILGLGGVGHMGVKIAKAMGHHVTVISSSNKKQEEAMDHLGADDYIVSSEPEQMGRAVDTLDYIMDTIPVVHPLEPYLPLLKVDGRFIIMGVIAQPLQFITPMIMLGRKSITGTFIGSVEESAEMLDFCKEKGVTSSIELVKMDYINKAMERLEKNDVRYRFVVDVAGSKIDL

SEQ ID NO: 532 - protein, 599 aa, Papaver somniferum
MKGDSKETLILLFFNAPISFHLLFSFFNVSSTLLANFFFSIYDHLIPIRSTCNDDDAEYHAFRHEEEHDHHYAGQKREYGHGFFSFDLLMEQKEDHLVADIIHGGESLLFIPFQSPKKEQVVFYEGIGCQEKIILQENGADEVEEHHIHDYTVKEDTEEDVAAEDSTSYHNEDPTSDDDQEEIIIMEEEHSPDYFSPPEESDDQASELDVAVDVLHQDEELSLLKDSDANSATTTMVFISTDPSENGYIAPVQIDLNNSGPVPNDDTSSEEERDGKESKDVKITMETKMLEDGKFFVLQTKKIQKNVVEDDMFEDSFSKKNDMFGDSVTEGSTSKSSSEWRNSVNYRDSGTGDDPFSTSSRRSCPTWESYTVFRKYDEEMLFLDRISAQKLSETESLRAIEACPRSISQRIVHRLTTKNKPKYHQFGRCNPYQELETAYVAQICLTWEALNWNYKNYQRLKATYSSENDPGCPGQIAQQFQQFQVLLQRFIENEPYEHGRRPEIYARIRNSAPKLLQVPEFRESEEDNNKKAGFINMTVSSIKFSRVMEDAIRTFMKFLKEDKEKPCDIFKAFFKRNSSQTVDPTYLHLMRKSNKRVST

SEQ ID NO: 533 - protein, 139 aa, Papaver somniferum
MEKLSVFLITPLAYEEGCVGEVLKAIEGSCLGIRGLILVRRPTDSGSSSEIDGDEYGVAVVASAVKSCLRIKPGNAKMSTIKNEYMTEFRIGSDYLRKIKQGQGPQGLLEATKKYSNMVSVFGDILQMTCCMVVCLRHH

SEQ ID NO: 534 - protein, 261 aa, Papaver somniferum
MHKIRLEDDAKPTREAQRRLNPPMMEVVKKEILKLLEVGVIYPISDSKWVSPIQVVPNKSGVTVVENDKNELVPTRVQTGWRVCIDYRKLNATTRKDHFPLPFIDQMLERLAGHSYYCFLDGYSGYNQIMIAPEDQEKTTFTCPFGTFAYRRMPFGLCNAPATFQRCMVSIFSEYVENIIEVFMDDFSVFGDSFDLCLHNLSLILERCVETNLVLNWEKCHFMVTHGIVLGHIISSKGLEVDKSRLTLFVLQPLPLRRGRY

SEQ ID NO: 535 - protein, 171 aa, Papaver somniferum
LNDAQQNYTTTEKELLEIVFALEKFHSYLLGTKVVVFSDHAALRYLLIKKEAKPRLIRWILLLQEFDIEIKDKKGIDNTVADHLSHLTVDEETIRLRESFPDEQLFSLQVVEPWYADIVNYLVSKKVPKNLSRAERDKLKRLAYQYICDDPYRCWKFSPVHSNSWSKGMSF

SEQ ID NO: 536 - protein, 219 aa, Papaver somniferum
MDASTPAHASAAEKDLLVSSRSHCRKSVQQFLGEGSVADVLLWKNQATSGILLVSSSIIWFLFEIAGYNPLLFFSNFLLILVVTLFFWGKLAYFLNWPPPSLPNLQISDDSILKISSDVHVLINRVLETGHAIIVGGNVKLLLKVIVSIWIVAFVGGLFNFITLVYIGVVLSLTVPALYNNYQDHIDDKLFAAHEVVSAQLRKFKLNMLTIQSEEKKLH

SEQ ID NO: 537 - protein, 176 aa, Papaver somniferum
MISSLFNVSALKAHSIVLIPKDPTAVTPHALFLTYKAANGGEPMDPEVYPRPTGEVYVCGMSAKGEVPDNPEEIMGDPESIKVLKRVAGTVSSHLKEGEVEVKAEQACFLPLTDDDKPVIGEMPNVKGCYVATGHSCWGILNGPATGAAMAELVLDGVSSIVDLTPFSPARFVKKY

SEQ ID NO: 538 - protein, 197 aa, Papaver somniferum
MSSGDGPSVEGNTQIVTVPERPKHSLPALPLAPSNVGNAIVEYKKANPKDADEDIEIKLRRILEQVPVRVSNTSGSSAGSGSGDFHQYRQMRRKEQDRLARMRVDYDKRKELSDFMIRKEERMKAAEERTAKKRLKRQKKKMKKQSKKSRLNPDAGEQQKDESSEDEDKSDDDAGEPEIPKHIFVPAGNRGKGAIIL

SEQ ID NO: 539 - protein, 377 aa, Papaver somniferum
MPTTRSSSGSITPSASMPNYSGVGSLDSSSTEASASPYVQPPCNDNEFVGDAACHCPYKHFEDCQDGLSGRGYAKTSILKHIKDRHLSIENGISICRERIHAMAYVYRSWERFLKQLQMWLCFPCMRWYSWKRPCRDHGGSIVIKGPFNGRSADFLLYGVDKPTSATCDTNTNLDIPTSSVDNSLCLSVNLLDLVFQKQIAAISSIPPLCRLNFSRTLKASLDKVLFQPNDLDSWLQLLLLPTCTLNIYVPKSSMEERSGTRRRLQTSSINQALAKWREPNGCITLVQQLLETNKEIQSSRKLSKKKQKPDIEDCKKKLRYGHYKAAIRILSSNGVAPYNPDTLHELQLKHPYAPPPIIPPDIILMLHLCLLMSKLF

SEQ ID NO: 540 - protein, 208 aa, Papaver somniferum
MIGVLMKKRDLRLASFSTPTYRKSAVSASTPAALLISALFISFGYPLDFQSGFILDLFSTRSIFISAVRTSSRCFRSAMVVSLMAYVLIFVMRFSCSGHYVFDISPKCGKDLCRKEQQLHRLFRRVPYVPASKVSVKSYLEGLGFQIKIKTCSRVVDHVSTIQALPYICGCYCYYYYGSLLCLIRITATDRVIRQPNGLARLLICRSR

SEQ ID NO: 541 - protein, 121 aa, Papaver somniferum
MWLIIITLLLSFTLDCALESSCLQNPLVTGRLNCFIVYSRNSMTATKSARKTKIIYFANEDYEEKKHKNMNNMICIQKISIHTYKLATHMEDHNRNLYCFYEQILKPPLRPQTFALSLPPD

SEQ ID NO: 542 - protein, 379 aa, Papaver somniferum
MNHHQNMAGGQVNTHFYVVFFIIFFCCCSVLVQSQVPKNKTFRIINQGDYQNVVSEYGSTFRFAKPNANFNMDPFGLYFYNTTFNAYVLGIGGGSPYQNMMLRTDNQIHWVWDANRNDPVREKATLTFSRNGNLVLADVDGRIVWQTYTANKGVTGIIMRKYGNLVLHDKNGRFVWQSFQHPTDTLVAGQSLQLKGNSIKLVSRTSNRNSCDGRYSIVIDDKHGLTMYKNTSGKLVRYAGWEAKGVSNVTFHSVTRIDPVQPEPSFEEKGNTSYFLSLGFSVGKKAKTHSKRVILKIMATTFGHYSHLRLESDGNLKVYSYSLRQNFPEESSWKKDYAFFGDTVKECALRSKCGTSGKCYGRLCSACPRNRSSGCMITS

SEQ ID NO: 543 - protein, 160 aa, Papaver somniferum
MVRQLTVHHHAGGCFSTVNVPVVAVALFVSVTVLVGLCAKHTIRRRQLAREKLGCNPNDSRVTPGSSPSRGLFATISNKAFPFMSNKKSGDQHGDNYEIVGDGGVWQRGILMGGKCQPPDFSGVIYYDVAGRQLSEIPRSPRASPFPSSFSFPAAKDGNF

SEQ ID NO: 544 - protein, 136 aa, Papaver somniferum
MKKKSVSALSSNFMLQSCIVKKKVYLVYTSIFTKGQAHPKGPWGEKKEERKVKQPITYPKMYDQLQRLLIYQIPKENTAMDLCCGSSSQNGFMLLLEYDPDETVDEFERFWDSTETMTIFFWLMLQFLSSRPSQSA

SEQ ID NO: 545 - protein, 151 aa, Papaver somniferum
MLRRARSTLGLQESTSLLIKKQDSMISSQESNSNIIAVKPTFKLSGGSLKTSSNGIFSSVSESNFMKACSLCRKKLSPLKNIYMYKGDQSFCSDVCRCRKILIEELLMEEIEEEETTMEVPTKDIVSSSICFATNLGNGLPPRRNHVQAAA

SEQ ID NO: 546 - protein, 414 aa, Papaver somniferum
MPLGDKANSAAKWDRIVELCKARLASWKRRILTRAGWRNVCKPINIGGLGIRSLKHLNCSLLQKWWWRLGNEPKALWSRVVKDKHGPVDLGWRTHKPKGKHGISLWRNIYSTAEDFFKLCQFKIGKGDRVRLGEDKWCIQGPLYALFPSLYNISSTKNTCIFAAYHDSANGFYWILGLSHRRRLYDNEISELSVMLPLLESIVFLPNEEDQLVWLGDKKGMFTVKAAYAHLSQGTNPPISFPSSKVWSRAWPHRVGFFLWKVCLNRLPTLSNLHHRRTALHSPSLCYLCGIAEETEDHLLLQCPFSLRVWNYFIGLAGGGTLLQTVKDVIVGWKNFPFSAQGLQLWKRLPAAIPWALWKARNDIAFERKPFKVNDVIRNIKMDAFNWSRGLDCFKGINTSTVIVGWAHFFLNPP

SEQ ID NO: 547 - protein, 589 aa, Papaver somniferum
MVETLIGNNSMTTSREMFRFTKQLLKGRWFMLFAAFLIMSGAGATYAFGIYSKEIKRTLGFDQETLNLLGFFKDLGASVGVFSGLIAEVTPTWFVLLVGAALNFFGYFMIWLAVAGHIAKPKVWQMCMYICIGANSQNFANTGSLVPCVKNFPESRGIMVGLLKGFTGLSGAVMNQLYLAIYGNNPKALILLIGWLPAVVSLFFVYTIRPMKVVKQTNERKMFYKYLFISLALALFVMVITIIQKQKAFSHGGYIATATVVCILLFIPLGVAINEELAIWKQNKQVQNSTPTSVTIETPPAIVAQTVDAKNPVPESSWYSNIFSPPKRGEDYTILQALLSLDMLLVFISVFSGLGTSLSAIDNLGQIGESLGYPSLTISTFVSLVSIWNYFGRVCAGFISEILLSKWGFPRTLVMTVVLVLSCIGDILIAFAFPGSLYVSSVLIGFSYGAQLTLVYTIISELFGLKYYSTLFNCGVLGSPLGSYVFNVRVLGILYDREALKQLKFKGLCRDSVKELTCIGKECYRMSFIIMAGVSLVGALCSLVLVMRTRDFYQGDIYKKFREQASGNKSEESEMGLAVSSVDDRKTLK

SEQ ID NO: 548 - protein, 290 aa, Papaver somniferum
MCNSAEIVVLSKNTHYCFNDLIAFYLIMLDRDTNRPRGFGFVTFADLRGMDDAIREMHGRELGERVISVNKAQPRSGGGGGGGRDDYGGGYSSGGRGGSFGGDRRGPGGSDCFKCGRPGHWARECPSAGGGGAGGGGAARSRFSGSGGGRGDRFGGDRFGGDRYGDRYMDDRYDGGRYGDRDRVDSRDIKYGGRDRYAGGDRYPAAGGDRFGGSDRYGASDRYPQNGYSKDRAYDRDAAPRTGFGAAGAGSDRYGSGGPTRYEGGSYRDRAGPYDRPSRGARPSSYEDRY

SEQ ID NO: 549 - protein, 774 aa, Papaver somniferum
MGESGDVAAALSVDRRSELKSPPPSKVAPWLVIPYGEEGMTENQAFYNICEPNKKTLRKCIPELSGKTFKQKTSHQGWCIIVCDDPDVDYAPDWNFGDCFLWNPATLQTIELPSLLFYIDNDKEFHHKDCVLSSPPSGEDTDNDSMVLFLFERKDKRYDHVLIYCFPGDKQWRTHTVARDMVDFEDVTSVCYFKDKFYVMCVGDRHIEIEMQKLGDIVSFSIRPIEVPDTILWTTVGGIETTVTGTHFVECGDELFRIEITYPARRGSPRVDIAIYVAKYDFSVMELKEVTSFGDHVLFLSNNTSFSCSAAELGLSKGWLFYTLEQDQSLHKYEVESNGTTVILPCLKLPRPWYTSSWIMVHDKHHTKEKMFGRDEELKAVLDNKTSTTGSDSNEDQRETNGRRELQEAIPWDILYEDMVRLIANYLHRLDYIHFRLASKANRVLMPMVKLASTCTTRCTDLSPWLVFSRDKCQEVYNFVNPMHNNENYLMNFSDLVGATIRFQKGGWLLMSKGSASIFFYNPFTKEIINLPDLPVDTFSGISFSSSPTSSDCIVFAIQQMRVSDGMSNEISIYLIKRGATSWSSCDFQNKNVEKFMPLLNTPVFYNGVFYCVDYNGTLGVFNLEDHNWKILEKPLQQFSGIYPSFLVECAGQILLVSLGHLGASVRVFRLDFSKMVWDEVRDLGKHMLFISYTSCISAIALNRRMENKTYFPRLCLNGEGVLFYSLETGNYHSFGTRHSANNFYDTEGWYTNCTWIEPNWSKAQELDWLKPLL

SEQ ID NO: 550 - protein, 428 aa, Papaver somniferum
MRLMNQVLQPFLSKFVIVYFDDILIFSRSEPEHLQHLSQVFQVLADNSLYVNLKKCTFMASSVTFLGYVISTDGIHVDPSKVQAIEDWPVPTSIRDVRSFHGLASCYRRFVKNFSSISAPLTDCLKKEKFEWTEAMDKSFILLKEKLFTTPILALPNFNKPFEIDCDAFVVGIGAVLSQEGHPIAYYSEKNSDAQKKWSTYELELLALVQSLKQWHTYLIHREFVVNTDNHALKFLNTSAKVNRMHDRWLSTLNKYTFSVRHKSGKLNQVADALSRRSHLLTTIRNESYAFDYIKDIYPEDEDFGKLWDQCSSQTHGVDDFLIQEGFLFKGNRLCIPQGSLRLHLMRELHGSGLGGHFGRDKTIALIEERYFWPSLKRDVQKFVQKCMVCQRAKGTIQNTGLYTPLPVPDAPWVDISMDFILGLPRTA

SEQ ID NO: 551 - protein, 790 aa, Papaver somniferum
MTAQPVTLAAIKALIKSHTEILAKNITEALEKSMEDKLGLRDTKLETMQNQILKVAKHINLDLEMPELVDLEGKNKEDILQFLQNDEVPEDVLRTLNIKKPYEGFIGHSKKKIVSPALDNDDEDERENDLEKNWTEERRLKTGHNPYSSLPEYKLKANIPNFSGNFRIEELTDRFFEVEAFFEFMEVPEDSKVKLVTYKLKGGAAAWWDKICDDRRNANKPKIRTWKRMKTLIRYKFLPRDFMQQLFIKLQNIQQGARTVEEYVSDFYNLVARNQLKESEEQLVARFIEGLNRLIQNGMTHSVFTMVEVVQQAIKIENRLIRSSRIYPSRQGRYQNTYRGTNSSQNFSPDTVLNIPRPPYDDVSHSHRQPSHIVTYTPPLATPILANSVDLQPGQQSHSLQPTPPTTGNRFHNRQQQFPPQQRANNACTKFRGDKCNKCQQSGHTSSDCRKFNALIGEPQFINEVTGALNEFEYEDSPGDDDEFVGMIRPLFLTQQCKSQRHNIFKSRCYIGGKICKMIIDSGSVHNCIADHVVKKLELPVTSHPEPYTVGWVNASSTQKITLQCYVSFSFEGYEDTVLCDVINMTATHLLLGRPWQYDLQAVHNGFENTYTFVHNGKTKVLSPSNSTSNSCAQTDAVVATVIRSLHPQHSLHSHEDSKPMIEFPPLRNIQHYIDFIPGASLPNQAHYLLSPAEHEILQGQVNDLLKKGLIRPSNRPCASPAFLVSKKDNGWRMCIDCRALNRITIPYRFPIPRIDDMIDLLSGSIIFTKLDLRSGYHQIRIRGGDEWKT

SEQ ID NO: 552 - protein, 125 aa, Papaver somniferum
MKDLGKARKILGMEIERDRRSDTINLSQKSYLKKLFKRFGLDDKAKPVTQPLARHFKLNAEQSPKTVEEQRLMAEIPYTSAAGSLMYAMVCTRPDISQAVSVVSRYMHNPGKEHWQDVKWILRYI

SEQ ID NO: 553 - protein, 132 aa, Papaver somniferum
MLELLNQLDGFDSRGDVKVILATNRIESLDPALLRPGRIDRKIEFPLPDTKTRRRIFQIHTSRMTLADDVNLEEFVMTKDEFSGADIKAICTEAGLLALRERRMKVTHLDFKKAKEKVMYKKKEGVPEGLYM

SEQ ID NO: 554 - protein, 140 aa, Papaver somniferum
MERAEKEKSVRLIKELEDLKCAKKRSDDEVEELKVKCRDLETQEGRLRNQIRILEEGNGKKMEMDQKKKKVCVEINREEELKIEDDPEIGVVAERKCMELEVQKTVNTVILPIDVIEIDSDNEIIEIDDNSDDKIQGGGI

SEQ ID NO: 555 - protein, 113 aa, Papaver somniferum
MGQGTPGGLNKQGGGAPGGNDGDNNKKEKKFEPPPPPTRIGRKQRKQRGSETAAARLPAVKPLTKCKLRLLKLERIQDCLLMEEEFVSNQEILKPHEDKNQEDRSKVDDLRGS

SEQ ID NO: 556 - protein, 238 aa, Papaver somniferum
MDFDEELGDEKFGVSPTSYESSRPTKMVATGEVVAVSTRKSACRYRECLKNHAVNIGGHAVDGCGEFMAAGEEGSLDALKCAACGCHRNFHRKEIEGEGFHHHPSFTPYSSYRAPGHGDSGTYLHVPARPLALPSTSGGGGNNTSRDDQDEDNSHPTSSGGLSSRKRFRTKFSQEQKDKMLSFAEKLGWRIQKHDEAAVQQFCNETCVKRHVLKVWMHNNKHTLAKGCMMMMMIKRRS

SEQ ID NO: 557 - protein, 502 aa, Papaver somniferum
MALQEHNQLHFVLFPPMAQGHLIPTIDMARLFAERGITVTIITTPLNTFRFKTIIDRAVDSGFSIRLLQLRFPSVEAGLPEGCENVDSLPSREMVSNFFKATSVLQEPLEQLLGVLKPVPSCIISAIAFPWTAETARKLQIPRLVFHGTCCFSLLCCHNILEYKVADSITSESESFVIPGLPDRIEIIKAMLPGNLPQSSGDLKNFRDQINAAELTAHGVVVNSFNELEPMYAEEYLKAKFGKVWCTGPVSLCNKETLDNAERGNKASVDESQCLKWLDLKDPGSVLYVCLGSLCRLTTSEMIELGLGLEASKHPFIWVIRGRDKYLDLEKWLLEEKFEERNKDRGLVIKGWAPQILILSHKAIGGFLTHCGWNSVLEGVCAGVPMITWPMGEEQFFNEKLVVQVLGIGVKIRGDDIHASDATKPMELMEEHRKFGSDENKREEVEKAVNRVMDGGGEGEERRRKVRELGERAKKAMEGGGSSQLNMTLFIQDIQQQGPKQG

SEQ ID NO: 558 - protein, 179 aa, Papaver somniferum
PPPPAGKEKGSISREKEEEMSSRGGGGSSSSSRQNVNSVFYAESYHPIQAGSIDGIDILPHDNAVYRALLCSSAGLYDPFGDPKVTGDPYCSLFVGRLSHLTTEDSLHKAMSRYGRVKSLRLVRDIVTGASRGYAFVEYENDREMRRAYEEAHHSRVDDCEILVDYNRQQLMPGGYHKD

SEQ ID NO: 559 - protein, 248 aa, Papaver somniferum
MVPVNKNLNQNQSKKETNPNQPSTSSDTEDRSNPNPNNNPAVTVESTSSVSPLVIEGDEEDTILKKSEYLTREEVIRRRLRRVRQMEKLYKDHYWSLMEELRVKYREYYWEYGKSPFKEEETRERGGNHHNNNGNGGLANGGGVVVEGSGDNHNNVNGGVGGGGGSGSGGAKLGLVNGGEDNNDGKYKRCVFVGCKSKPMALANHCHQHIILDSRQTLYKTCNYVTKRFDFCSLLSFDSCLFFWGFWG

SEQ ID NO: 560 - protein, 550 aa, Papaver somniferum
MLCSTKKQGMERLIVVCLCVSLLSIFALADPGAVGVNYGRIANDLPSAVKTVELLKSQGIDKVKIYDTDSAVLKALSGSSIKVIVSLPNENLTAAAKYPSFALSWVQKNIVPYYPLTQIHAIAVGNEVFVDPNNTTDVLVPAMKNVQSALVFYKLDSGIKISSPFALSALQSSFPASSGSFKTELIEPVIKPMFNFLRETKSYLMLNAYPFFAYSANADVISLDYALFRENPGVVDSGNGLKYTNLFDAQVDAVYAAIKALKYDDVDIVVTETGWPSNGDKEEIGANPENAQAYNGNLVKRVLTGGGTPLKSETKLVVYLFALYNENKKFGPTSERNYGLFYPSEEKVYEIPFTLEQVKTWKLKPASDRKAQSQAPAKPVYSGESAGSNGTSGVSNSSSAKGPFCVANVKSGKERLQKALDYACGAEGGADCRSIQPGAACYDPNTLGAHATIAFDSYYQNKGRANSACYFGGAAYVVTVPPKLGKCDLTMDSEEDNGTKGAGKLFVQTNNKENAEAVEVSLSSPRLVTLLGSGTFDISWVLLVLMYLSF

SEQ ID NO: 561 - protein, 130 aa, Papaver somniferum
DSLVLVYLSYCFLNFVPQELMGLLFNGKMESILRKINPWPWLPRPNPFSEHVPEFLGRRISNLGLSIVLYSYPKSSTLEFFYFLPSRKNLTETLKISGKIVKSPLSTIVSYPRPSLFLGNQSHHKIKKQR

SEQ ID NO: 562 - protein, 119 aa, Papaver somniferum
MKTLMQFMNLRTHLKLGKYKGNLILSTRLLSDFDLSSGNIFSATKKMATSKSILEIALRTLYLLICVFQKIFHELLTLCQFLHLCRIYQVEIGLINLPENVVGSLYFFFLFYIIHVFSF

SEQ ID NO: 563 - protein, 262 aa, Papaver somniferum
MIWNPFTKDYRKLSTPPKPDLDPSYVYDFYSYSKYGFGYDSKTDDYKFARMVKCPGSSTEISVYSLKLNLWKTYRDIPFLLPFNGGLVLFQGIFHWVGDRSRNIEISRDFPRGFKLPKIIGCLDTGSETFKEIPLPQHFAELFGIFVCVLGGFLYIIGFRYVNIGSEAWMMKDYGVHESWTKMFNIRETSSNLVGAGCLNLKHYFKSGVILVQVDNGRCLLFDLKNKKLTKLEISDHTLFYTWAFLGSLVSPNNLDTCLGMQ

SEQ ID NO: 564 - protein, 432 aa, Papaver somniferum
MSDLDLSTDSEDEAFDTEEESSDDEEVSSNNEFELSIFLNILSAVHSWLMDIIKQLQYIQSQRIERPMRRPVTLFGYNYIRRVLRQDPEDFRRSYRMYPDIFLKLCCIIRESTSLCDTRCVSIEEMLGTFLLVVGQSSRYCTIRDTFGRSRWTVSKNFNRMLRALNSIAPRMMAKPTSATPFKIRESTRFYPYFKDCIGAMDGTHIPAMVEKRNAAVYRNRHGITSQNVLAVCNFDLEFIYVLSGWEGSAHDSKILNDAMTKRNGMKIPQGKYYLGDGGFANRRYCLTPFRGQRYHLKEFSGTGNHAKKAEELFNMRHASLRNVVERLFGVVKSRFLIFKSQPPFPYQVQAEIMTACAGLHNFLRKECRSDEFPVEEEENSHPSTLVNDDEILTQQTQEQQRQEANAWRKSIADDMWENVREQRELELYGDR

SEQ ID NO: 565 - protein, 127 aa, Papaver somniferum
HVLYKYGFGYDLKTEDYKVARIANIRDKYSEIAVYSLKLNLWKMYGDIPVRSPYEDLVLFEGIFHWVELPPSGSQRPRMIFSFDTGSQILNRIPLPQHFSDKFNMIHVRLLGGCLYLIGSLYMTCSE

SEQ ID NO: 566 - protein, 580 aa, Papaver somniferum
MEKQKSFRRGMEKQKSFRGAMEKQSSFRGVMEKQSSFRGVMERQKSIREALEKQLSFRDKKKVKESPGKRGDTPLHLACRGGNLIKVKEILQDCDSLKDVLTKQNKDGETALYAASEYGNAVIVSELLKHMDSESASIPAKNGYDSFHVAAKQGHLEVLKELLRSLPDLALTTDSSNSTALHTAAMQGHIDVVNLLLETNVDLAKIARSNGKTVLHSAARMGHLEVVKSILRKDPGVGFRKDNKGQAALHMAVKGHNVEIVLEMVKPDKSVINLEDKNGNTALHIATKKGRTQVMRGLLSVEGISINAINKAGETALDIAAKSENPEIASILKEVGATSAKDSANPPNPAKQLKQTVSDIKHDVESQLHQTRQTGVRVQKIAKRLKKLHISGLNNAINSATVVAVLIATIAFAAIFTVPGQYVEVKSDGFTLGQAYIAKNAAFIIFFVFDSLALFISLAVVVVQTSVVVIEQKAKKQLMFVINKLMWLACLFISISFISLSYIVVGRHARWLAIYVTVIGALIMLTTLGAMCYCVVMHRMEESSMRNIRRASGSHSRSFSVSGISDTEILNNEYKRMYAV

SEQ ID NO: 567 - protein, 275 aa, Papaver somniferum
MGGWQRHIQSIIRHAGKRLEQCCSPPLSLPSARINASFTLGQFCYLHRTSNTSPTNILRPLHQYLKQSGISSSRKLLSEASSDQTPVANPLSSPVLQIGDGTTETQAVVPKRASVQAVLKDIKQSPKKVNLVAALVRGMRVEDALLQLQLTVKRASKTVYQVIHSARANATHNHGLDKDRLLVAEAFVGKGLFKKRVSYHAKGRSGVKVRAECRLTVVVREMTPEEEAEIARLRVHNFRKLSKRERRLVPHKLIETTPVWGRKSKPSNSEKSSMA

SEQ ID NO: 568 - protein, 287 aa, Papaver somniferum
MGNLLCCVQVDQSKVAIKERFGKFEEVLDPGCHCLPWFLGSQIAGHLTLRVQQLDVKCETKTKDNVFVNVVASIQYRALAEKASDAFYKLSNTRGQIQAYVFDVIRASVPKLILDDVFEQKNDIARAVEEELEKAMSAYGYEIVQTLIVDIEPDVNVKRAMNEINAAARLRLAATDKAEAEKILQIKRAEGEAESKYLAGLGIARQRQAIVDGLRDSVVGFSTNVPGTSAKDVMDMVLVTQYFDTMKEIGANSKTSAVFIPHGPGAVRDVVTQIRDGLLQGSSAHMT

SEQ ID NO: 569 - protein, 616 aa, Papaver somniferum
SKTESYCLKWICNKKSEFPSNFILFFLSCCCLLVYYTLLLLLLLPLNPHSSPPSPPPPPPPNSSQTGFYTMEDAQSVATLIDSTTTKIQQLQQAFAELENHRAVSLNLKWKELEAHFHGLERSLKRRFDDLGDQEKEFKNKASEARELLEKKKAAVKAKEHASLEKLQQKRDAALFVIGDAFKKYKTSSVKPVVVKVEDSCESDLTVEEKPPDMKVASVDPDEVNKISDNETMDVKPRPELAKLCEEMDSKGLHKYISDNRKNLATIREEIPFALMISADPARLVLDSLEDFYRIEAPTSDGKRDSGLLGLRRTCIMLMECLAQSLADTGRVCFSDVINHDIKEHAKAIAEEWKPKLDDLDVDASSGNSLEAHAFLQLLATFDIAGDFDEEEILKLIPTVSRRRQTADLCRLLGLSHKMPGVIEVLVNTGRQIDAVNLAYAFELTEQFSPVVLLKSHLKEARKASSPTKPGNASPTAENEVNDRELTSLKAVVKCIEEHKLEGQYPVDPLQKRISQLEKAKADKKRVAEAAKPQPKRPRANGGGFAPRVSNINDKSFYATVPDRYPPYNYENMHYVYPGHTNNHPTPVLGAAAYNIPPNHGSYFGNGYAYQAPYLH

SEQ ID NO: 570 - protein, 404 aa, Papaver somniferum
MVNIIILFSLKLVVIFHIIFPLSATAVTYNVLNFGAEPDKGTDSTEAFLQAWSLACSSIAPAMMFIPRGTYLVNTIVFSGPCKSARVTVRIDGKIQAPPSSYWEIGNYGTWILFQGINGLTINGGILDARGSPFWICRRASAYCPQGATSLSFNNVKNGIVSGIVSFDSQKAHMAINGCKSMKIRKVTLIAPAQSPNTDGIDIQSSTGIKILDSSIRTGDDCIAIGPGTKSLLVQRVVCGPGHGISIGSLARSPNEAGVEGIKVKDVTFTGSDNGLRIKTWPKPSDSFVKNVLYQNIIMNNVRNPIIIDQIYCPGTNGCSDQNSGLKISGVTYLNVSGTSATPIAISFHCSATTPCDGIKLSNVNLTYSKQPAKSFCFSALGTSSAGQLGTSLSVGRPTPGSCF

SEQ ID NO: 571 - protein, 208 aa, Papaver somniferum
MMEEVIMMSMISPSASNSTSPPGGGGGGGAKEQQAAGVGILLQIMMLVLSFVLGHLLRRHKFYFVPEASASLLIGLIVGGLANVSNTEASIRPWFNFHEEFFFLFLLPPIIFQSGFSLAPKPFFSNFGAIVTFAILGTFISSIVTGVLVYLGGVLLLMYKLPFVECLMFGALISATDPVTVLSIFQELGTDMNLYALVFGESVLNDAV

SEQ ID NO: 572 - protein, 144 aa, Papaver somniferum
MRNTPADGPVSTNEPLEWDMKDLPIDELIDEDVSSDSTTKEDQMHTEPGKIFVGGMSWDTDEATLKDHFNKFGEVVETNILIDRTTGCSRGFGFVRFSDKSVADKVLLEKHVILGKKVDVGKVVLKHNNPYDRKGFNKSNGNNG

SEQ ID NO: 573 - protein, 137 aa, Papaver somniferum
TRKVRSLRDIYNVSNCAFIALEPQKYEEAAKEEKWRNAMDEEMRVIEKNKTWELVNQPVDKEIIGLKWVYKIKYNEDGSIQKHKARLVAKGYSQQPGIDYNETFAPVARMETIRMVLALAAQLKMKVYQLDVKSAFL

SEQ ID NO: 574 - protein, 366 aa, Papaver somniferum
MVDMLKKKAFHRWISEKDLRVDGRRLDNVRRLKCEYSKVSELEGSSQFACGLTQVTCTVTQRRPTKDEAKNMGGNHPLLRFPRFLYNSPPFRVDGNWKLGDCNSYDARDGDFVEKALVVLLPVEYNFPYVVCVDSEAIHSDGSVSTATICGGSVALMASGVPLKKHVAGVSVGTVSEVYPTDGKMNNYRILTDLSSLEEHLVDMNFKVAGSRDGITAIRLDLNVAGVPLGIICGCLGPALKGCLEVLDTMDQKISNPIYCTSDDWGWSDATVVAYRLPTKSIERLTVSNGAWQRDFERKTGTRISLTKNGAVTIAAKNETSHLLARQKVENIIAHEVEFGRLHEDEATLMKSYVEISAEQVERAYM

SEQ ID NO: 575 - protein, 113 aa, Papaver somniferum
MITGSIAPSSLHGLGCSLLGVTNPISFDPLDSVITMMLPSRVSARPTQALFMHRLIFNPLSLTERYHYHHHQQFLQNTYLAPPIVPDFLIDKNSNIVGSFMLFHIPSTSRTIS

SEQ ID NO: 576 - protein, 116 aa, Papaver somniferum
MAYEMTEKFEEYWFVINGVMAVEIMLDPRFKMKLIEFYFPQLYGQAFPKIKIDRVRNLCVDMATEYELKVKFAETSVSQNDLSFTSEMHGFNDDVDPLEKFDMFVFSTAPTSTVKS

SEQ ID NO: 577 - protein, 386 aa, Papaver somniferum
MWKRSASFILDQRHENNKPPLDPSSSSNQMAAEKNSKISAYYQTRSAHHAVVTSDWLAQSQEAAIEFDPSTNDYLKSSTGNSGEKPFSVIDEFNHWRQLPELAEAVAAILALASVIRFSKASTIMELERELKTASDSLKSWDTTSISLTAGCDLFMRYVTRTSALEYEDFDAAKLRLIERAEKFGEISRKARRTIAMLSQDFIFDGCTILVHGYSRVVVEVLKLAAQNKKLFRVLCTEGRPDRTGLRFSNELAKLDVPVKLLIDSAVAYTMDEVDMVFVGADGVVESGGIINMMGTYQIALVAHSMNKPVYVAAESYKFARLYPLDQKDLTPALRPIDFGVPIPSGVEVETSARDYTPPQYLTLLFTDLGVLTPSVVSDELIQLYL

SEQ ID NO: 578 - protein, 169 aa, Papaver somniferum; identical to SEQ ID NO: 97

SEQ ID NO: 579 - protein, 514 aa, Papaver somniferum
MDAIEFPYQRDVSVSKNLMGKGFGRERMLEGDRSESISVGSVPRSSGLIGCSTSGSIKDKARAVKQKHGLDGKRSDRNKVKPPMKTKLDSFFSKNGITSNNSSSGGNNILGIYGLKSDIHAVTSHVDELSLNEILDGSYKCPILSQSKGRKSANTTDNILHSVRKVCSILQPQRAPEPSQKDVDLDSGSIKMEACISDTGFCSSKREENDKEDGDLHGETSSCKIEDSHKKFLDAKLLHQPNVILERLAFQPVKDLDSLLHDTAKPGVSVSPDIRAVKGTSQRYRLPPFYWSHSFTGSCKTNVEGSKLTIRSSAFQSRWVRIESTASTQGDSTGCFSDLDSFACDYNLNTLKHLNVGLSEKEPTSASISFHKQVLLSTSKDPLTGFPHKSDNYLGAQSKFGFNMNIVKDGRKIENSYGQEKYLRFEENKDNGVGGEPSKRRKGACSTEDGSCYSMFKSSVTGYPNFPLHIHDPDDTKHDAHSPRLLAAAQILNEISRLSRTQNQNRGKNRWPKK

SEQ ID NO: 580 - protein, 178 aa, Papaver somniferum
MPFGLCNAPATFQHCMMSIFSDMVERFLEVFMDDFSVFGSSFDECLHHLSLVLTRCKEKNLVLNWEKCHFMVRSGIVLGHIVSSKGIEVDRAKVDLIKTLPVPKTVRDIRSFLGHAGFYRRFIKDFSLISRPLCNLLAKDVKFVFDEACLEAFEKLKTLLTTAPIVQAPNWNLPFEIM

SEQ ID NO: 581 - protein, 349 aa, Papaver somniferum
MYIAVPVVLYACERIVRFFRSGFYSVRLRKVAIYPGNVLTLQMSKPPNFKYKSGQYMFVQCPAVSPFEWHPFSITSAPGDDYLSIHIRQLGDWTQELKRVFSEACELPLAGRSGLLRADETTKKSLPKLLIDGPYGAPAQDYKNYDVLLLVGLGIGATPFISILKDLLNNIIRMEELADSISDTSRTTDQSVGTSSDSSVSKFSPKRKKPLKTTNAYFYWVTREQGSFDWFKGIMNEIADLDHRGVIEMHNYLTSVYEEGDARSALITMVQALNHAKNGVDIVSGTTVRTHFARPNWKKVFSKTCSKHPNAKIGVFYCGAPVLAQELGKLCHEFNQKGSTKFEFHKEHF

SEQ ID NO: 582 - protein, 632 aa, Papaver somniferum
MRGFPKHERRWASDTVSSGKFASGSSSPVNNETSGAMDQEFVQVTLDFQDDDTIVLRSVEPATIIDLDQEIVISGSGGGGGGSETSLSSAASRSPTIKRSSSHKFRQFSQELKKETVAKAKAFSQEFKAELNRRFSWSHNQSSKTLSSSTAVANDNNAGTSDSALAARALRKQRAQLDRTRSGAHKALRGLRFISNSNSNSSSHRNNINSVDAWNEVQSNFDGLAKDGFLFRADFGQCIGMKDSKEFALELFDALSRRRRLKIDKISKEELYEFWSQITDQSFDSRLQIFFDMVDKNEDGRITESEVKEIIMLSASANKLARLKEQAEEYAALIMEELDPERLGYIELWQLETLLLQKDTYLNYSQALSYTSQALSQNLQGLRSRSSIRKVSRNIIYYIEDNWKRLWVMALWIGIMLGLFFWKFFQYKNRYPFKVMGYCLVTAKGAAETLKFNMALILLPVSRNTITWLRSTRLASVIPFDDNINFHKTIAGAIVVGVILHAGNHLACDFPRLIKSSNDVFEPLKHDFPGDHKPTYAALLRGPEGVTGILMVIFMVVAFTLATRWFRRSLVKLPKPFDKLTGFNAFWYSHHLFVLVYILLIIHGFYLYLVHQWYQKTTWMYIAVPVVLYACE

SEQ ID NO: 583 - protein, 657 aa, Papaver somniferum
MLVDATSGYGMFSFMDDYSGYNQIKMYEHDANKTVFRTPIGNFHYTVMPFGLKNAGATYQRAMTAIFHDMMHKQVEDYVDDVVVKSKTRASHLEVLRQVFERCREYKLKMNPMKCAFGVSYGKFLGFLVTVEGIKVDPDKTKAITTMPLPCTVKEFQSFMGKVNYIFDASFIPLLKKGASLTWTTVQQEAFQKIQQILFSPAVVKSPVQGRPLILYKASSDVSIGAILSQEDEERIERLIYYFSRTMRDAQLRYPKAERACLALVHAIQKFRHYLLSNRVMLVSKADPLKFLLSKPSLIERPAKWLLQMSEFDIACVLPREFKGQAVSDLLAAFPGEDTTKLHEDVPGEFPEILVIKEETWLLYFDGSPTPRNDTEGAGVVLVSPSGKVFSRLFKLDFHCTNNSTEYEAFLLGLSLAKQAGAAHLEIRGDSKLLVNQMNGEYSLKEITLAPFRTEAQRILTHFAGATIIHTGRTNNMHADCLETLASKLQFEGAKKTITVKWRAVLSTWLAQVEDIQTNDWRAPIIHELSNSLSEGKVSLKELKNYFLLHGALYYRNPDGSLLRCLGNDEAGEKLKRIHEETCGHTLVVTLYRRLQRMGYYWPSMEAQSRNLQRSCPNCQTPPHHLEALTVRHTEDWREPYIKYLRDNELPLEKGRQ

SEQ ID NO: 584 - protein, 222 aa, Papaver somniferum
MAINLSLGGKLTLILSVLMSLPIYLFSLFFAPINVIKKLEIIIRNFLWDGGVDRKKYHHVAWDIVLKPKNLGGLGVKDLHLMNIALLMKWLWKFGEDDNPLWKNLVSQKYGIEEHGWYARNPKQAYGCSVWRGIQNHLVDFKANCKFIVGNGERIQFWKDIWLGNTPLAEQFPYSFGASSHKDLTIAQMYNTSENSWSLGITRRIYDHVIVCFAGLLHALDE

SEQ ID NO: 585 - protein, 809 aa, Papaver somniferum
MKNFITITSSSPPLSILLHQTDVRAIANRYAAQLQFCCAQNPISHSLAQSVHANIITSGFKPRGHILNRLIDIYCKSNNIVYARYLFDKIPKPDIVSRTTLISAYSELGNVNFAKYIFDEAPLSIRDTVSYNAMITGFSHNNDGYNAIKLFNEMRKYGFKPDNLTFASLLSAAALVAHDERECKQLHCNVVKAGADLFVSVLNALISLYVKCGFSLSSPMSDARKLFDQMEKRDELSWMNMITGYVRNGEIESARELFDGMNENLQVAYNAMISGYVQHGFMLKALEMFKSMHLEGIELDEFTYTSVISGCANSGLFLIGKQVHGSILRTGWRPASKLALPVNNALVTLYCKCGKVDQARQIFDSMLEKDHVSWNAILSGYVSVGRIDGAKNVFNAMPEKDLLTWMVMISGFAQNGYGEDALKLFDRMRTEDLAPCDYSFAGAITACASLGALEHGRQLHAQLIQLGFNSSLSAGNALITMYARCGVVEAAHVVFHTMPYIDSVSWNSMITALGQHGHGLQALKVFDLMLQENIKPDRITFLIVLTACSHSGLVKEGCKYFESMDNVYGITPDEDHYARFIDLLCRAGKISEANDLIQNLPFKPGAPIWEALLNGCRIHGNMEVGIQAADQLFQLTPQHDGTYILLANMYADAGRREDMAKVRMMMRERGVKKEPGCSWLEVANKVHVFLVDDTSHPQVHEVYTYLRELGVKMRKLGYVPDTKYVLHDMESEQKEYALSTHSERLAVGFGLLKLPRGATVRVLKNLRMCGDCHTAFKFISKLVEREIVVRDGRRFHHFRNGECSCGNYW

SEQ ID NO: 586 - protein, 643 aa, Papaver somniferum
MMWNSLANIKENLNQIVLEVQDATDGEEFEIYRSNSNSAAEDSPIFNRRISHRFAQSNNSPLRSPISSGGDSALKSEIEKYKTEIQKFQASEAEIKALSVNYVALLKEKEEKLSRLHGENEMLRKNLEAANASQHASKNETFNKRNVHKGVGEQSPNRQHKLTAHVNNHSIGNHTHKSVIKHDTFSNGNADTLRSVENLPRNENELADLLEEKNRSLVAIQANYDSEIKKLKMELGRERESSANIHSKFTEEQKLNESFQKELLALKTQKNRDMTEMKQLQNQLNDKLSEIRRLQSELTRRDNEEETNEIIERLKGVIATLEQENTNLKIEKAELQAVVERSPKSLRADGDADNPDSSDSRPTKLNEAHSSVQFPQKEEMELSMQKLEKDLKEACRARDKVLQELTRLKQHLLDKELEESDKMDEDSKIIEELRASCDYQSSKILSLEKALQQAITDQEEVKKNNNDELQKSKEMVNDLKEKLSSCMRTIDAKNVELMNLQGALGQYYAESEARDRLEGDLALVREELARLSELLKDANQRIDIAKHEKDETLEKLSQTEMLLLEGKSRVHKLEEDNMKLRRALEQSMTRLNRMSVDSDFFVDRRIVIKLLVTYFHRNHSKEIDRFWTLWFACWASLKMISKE

SEQ ID NO: 587 - protein, 168 aa, Papaver somniferum
MKMIKPLYVSVSKRYGDKSRFYNGSVTTSPLQRSSPKKYKKECEDKFETSSKSPKQGNLPSGLRVVCKHLGKSRSSSNFAAVSPVTFPSQRQDDSMFQQEDGIQNAILHCKKSFNSRFESSTLFSNSDSSLLSRSISDPSHEKSIDFLSEKMKLFDQDEAENEEYFDL

SEQ ID NO: 588 - protein, 134 aa, Papaver somniferum
MFLVGVVFNLFKYQTLDKGTCNGSVSNIIPIIGTTSMFIIVASKYKMVLPTRSLWRCMKSPVTTMFFIKTLHRISTLITFHNANLSTKKVIILLYCKANFITSTHDSWPTPVTTNSHSADLLPFLVSTILLYAR

SEQ ID NO: 589 - protein, 342 aa, Papaver somniferum
MENMQYAEELIRQFLVFRGFTNTLQTFETELSTDIAKGFQVDKILELIFSVYVPKFQIEKLVCLLSFFKQCFSTSTETVLVSTLSKLEASVLRYYVVHAIKSGKRDKVIDFFGAYGNDLLQRSQDWGPWFAIPYLKNPSLEPQFRIYFSKEWFDALQLSLRNFLSEIFNDTRIPGLLKISADNNTVKHLKRDNKQLNLKLSQLQALLEEKEARIYQLKSNSSTAEVNMLQKNNPTYSESGAAGECATQSNYLSSRVMSESSTSRSTSSRDDKKEPEFQDLDSAERAKRSENLTQSGSEIDSSCLHELPTRDENGAEMQRQEDFPEVKAEFQETFLGHTSPIS

SEQ ID NO: 590 - protein, 299 aa, Papaver somniferum
MQQFDSEDSAMTFDEASMERSKNFVKALQELKNIRPQLYSAADYCEKSYQHSDQKQMVLDNLKDYAVRALVNAVDHLGTVAYKLTDLFEQQTLDVSTMEINISCLNQKLNTCQTYSKEEGLRQHQLYTTVPRHHKHYILPNAVNKKVQFSTQIQTDAVQKNIAARPRVHLSGTNASQTLSWRLASETDSTLNGSKHAVMQYPKGSNVSGTACGAFNLFDAEEAASSKSSSAQLHAGGRSPAYSPLRTFGVKWKDSSEASKPLSPFRSFDNVGRQERGRSPSRSKSMLSSFFAKRKTSKI

SEQ ID NO: 591 - protein, 267 aa, Papaver somniferum
MQRQEDFPEVKAEFQETFLGHTSPISRCRFSASGNNIASASVDGTVRIWTYDSSSPTTRNATIYCGSEIMSLDWECKSDRLLLIGTADGGIKAWNVDAKRVVCDLSTSASFPSVLDLKCSPVEPIFVSAAASRGHGSSNLDRMGFASLTVWNMKTWKAMSVLPLGEDPPAITSLCFNHNGKILAASATDGMIHMFGILDCLSYFCVSGNKFNLILLCSRMVCLFLNWSDQYNWKFASFVVYGLRHMNLYLTCCRYGCGSSNYRLACP

SEQ ID NO: 592 - protein, 177 aa, Papaver somniferum
MMNQQSMSLSLNRNSSSRKFAIRFVRALTRIKMATPIVSSVQSRKKCSRRIKCAADTSMAATIGSRRAWGRAILLKHRNQVRKRVLMRQKVVGNNKGNKTRKIKVMNKEKKQINKARKIDHIKGVQGSVNRANKLRKLVPGGDAMDFCSLLEETAHYIKSLNTQVQLMQKIADIYET

SEQ ID NO: 593 - protein, 477 aa, Papaver somniferum
MSAKFSPTLQISDLNDYIAPSQACIVSLKGTTTAKKQETAQNQVVIAPSVKQLNTEPVTISLKDCLACSGCITSAETVMLEKQSLEEFLTNIKDGKDVIVSLSPQSRASLATHFGLSPSQVFGKLTTFLKSLGVKAVFDTSCSRDLSLIESCNEFVARYKQQQSLPMISSACPGWVCYAEKTLGSYILPHISSVKSPQQTMGATIKNHICQRMGFRPENVYHVTVMMCYDKKLEASRDDFLFPLDSNGETRNDAENPMVAEVDSVLTSGEVLELLQRNSVDFKTLAGSPLDRLLTNVDEDGRLYGVSGGSGGYADTIYRHAAEVLAGKEIEGPLHFEPKRKNSDFRELNLDVEVEGEKRVLKFALCYGFRNLQNVVRQIKTGKCDYHYLEIMACPSGCLNGGGQIKPKEGQSAKELIQTLESAYMEDVVVANPFENLLVKGLYDEWLEQPGSEKAKKHMYTQYHPMVKNITSQLHNW

SEQ ID NO: 594 - protein, 545 aa, Papaver somniferum; identical to SEQ ID NO: 101

SEQ ID NO: 595 - protein, 126 aa, Papaver somniferum
MDLNRCCPKNDSPLPNIDMLVDATSGHGMFSSMDGCSGYNQIRMYEHDATLYDGNLPLEPIPQGSSLKKITMPTRYVEKDPCESLYQTMVHVYRAILENLRFWLSSGAVERSSATASALLPVSLKQ

SEQ ID NO: 596 - protein, 108 aa, Papaver somniferum
MQDDVAKLVRGCKLCSTSKPSNRKCGLYLPLPVPSRPWESISMDFLGGLPNTKSGYDYLFVVVDRFSKMIALIPCTKTVTGAGATKLFFEHVRKHFGLRTSIISDRDS

SEQ ID NO: 597 - protein, 111 aa, Papaver somniferum
MYADRVVAETNKRSVKERLNGDSDEEYGRGRTSFSKRQRQNDNKWKHDLYDDEDKPRVSTRRVAANDLRLKLQKKGLKKTYQKGKGSLAGGVQDLWVKLSVGLSKLHSTSF

SEQ ID NO: 598 - protein, 471 aa, Papaver somniferum
MLKSSLAPILSIIPMKPPKYPVACLSLFRPSAVRDNVSANAVEPPPQSYPTSAYIHLPFCRKRCHYCDFPIVALGSSSANLPDDIDDPRILNYVQLLCREIEATKVLKSDNHSPLKTVFFGGGTPSLVPPRLVSKILETLNSKFGVNSNAEISIEMDPGTFDAQKLSDLLNLGVNRVSLGVQAFQEELLKACGRAHSLKQVYEAIEIIGSCGASNWSLDLISSLPHQTSEMWKESLERAIKAEPTHVSVYDLQVEKGTKFGLLYKPGEFPLPDDTLSAEFYKMASKTLCNTGYNHYEISSYCKKGYECQHNLTYWKNGYYYAFGLGSASHLDGVRFSRPRKMKEYTSYVQNLEDGALIQHENGQKDAKDLEMDVVMLSLRTSKGLDLTSFRECFGSGLVLSLCKTFRPYIESGHVLLLDDKRRVLVAEEFWSVLSNESKIEEEVAFIRLSDPDGFLLSNELISIAFGCISP

SEQ ID NO: 599 - protein, 181 aa, Papaver somniferum
MDQPAVENYANPKTCFFHVLFKAGALAFYILSALFFNSFVIIFVVTVLLAALDFWVVKNVSGRILVGLRWWNEINDLGESVWKFECLDQESLSRMNKKDSWLFWWTLYLTAVAWIFLGIFSVIRFQPDYVLVVGVCLTLSIANIVGFTKCRKDAKKQIQAFASQTIANRFSSTIQSAFSVV

SEQ ID NO: 600 - protein, 436 aa, Papaver somniferum
MLLQLGSIPTLVITSAEAAEQVLKTHDLDFCNRPPLAGPKRLTYNYLDIIFCPYSEYWIEMRKICALQLFSVKRVQSFAVIREEEVSVIMDSISNATDPIDIYKLLISLIDKILSRVVFGKTFQSRDQSSDGTLQDILLETMAIISGFSASDYFPTVGWIFDRITGFHRSIEKCFHEFDDFFQQIMDMHLNPERQKSSHEDLIDVLLKIKQDGSSTVRLTNDHIKAILWDVLIGGIDTSAVTMSWAMTELMKNPEAMKKVQEEIRSHDLGVKRMVQESDLDHFLYLKMVVKETLRLHPPAALLIPRENTKHHVIQGYDVYPNTRILINAWAIMRNPKYWDKPDEFIPERFENRYADYTGGQNFDFIPFGGGRRSCPGMNMALISIELILANLLYCFNWELPNGMKKEDINMEESSGLSVHKKYPLELILTKYLVKV

SEQ ID NO: 601 - protein, 136 aa, Papaver somniferum
MAFAARIGSLLKQSISQNIIASNGHGSLPSMYNSLRCMSGGSNLFVGSLSYSTDDYSLKEAFSTFGEVLEAKVITDRENGKSRGFGFVNYSSEESASAAITGMDGKELAGRIIHVSYANQRPPRGGGGYGGGGGSW

SEQ ID NO: 602 - protein, 183 aa, Papaver somniferum
MQISRCIGDLYLKDNKYNTEQILGKFRLLEPMLKPVLSADPAVMSFPLQPNDLFLIFASDGLWEHLSNEQAVEIVHRNPRAGSARILLKAALQEVARKREMRYEDLRRIDKKFPTGFQRASNCIQVSAGSQKARVQDKEDICRIEENGMRDYHDDICRTKKISTGVAAIELSSGRNANMEEVR

SEQ ID NO: 603 - protein, 434 aa, Papaver somniferum
MEDEYAKFIRRMNPPRVVIDNDACEEATLIQVDSMKKHGILLEVVQVLTDLNLLITKAYISSDGGWFMDVFNVTDQDGNKLKDEGVINYIKMTLEANDCFLPSLRDTVGVMPSEDHTSIELTGTDRPGLLSEICSVLADLRCNVVNAEIWTHNARAAAVVHVTDQYTGCAIEDAKQLSTIKELLCYVLKGNNDIRTAKMMVAAPGVTHRERRLHQMMFDDRDYDKGNMVRMRRADDQDNKLSPEVTLLDCVAKDYTVVTMRSKDRPKLLFDTLCTLTDMQYVVFHGTVKTSRMEAHQEYYIRHIDGLPISSEAERQRVSQCLEAAIERRVSEGLELELCTEDRVGLLSDITRIFRENSLCIKRAEISTKGGKAKDTFFVTDVSGNAVDPKLVDSICHQIGVTVLRVKRNSTLCPKSPPETTGISLKLARFKISG

SEQ ID NO: 604 - protein, 212 aa, Papaver somniferum
MGSTGLSHGGIGSSRTTTSFKSSSSSVDWLGREMLDMNIRDKTLEEDDDKDSEPEVIDSVGAEAGHVIATTVGGRNGQSRQNISYIAEHVVGTGSFGVVFQAKCRETGEIVAIKKVLQDKRYKNRELQIMQMLDHPNIVALKHNFFSITGKEEPYLNIVLEFVPNTVYGVAKHYSRVNQRMPLIYVNLHTYQVCEVLDIFSMYFLTWSRSWV

SEQ ID NO: 605 - protein, 457 aa, Papaver somniferum
MNKLNFKQAQQKLGFTINGIKKSDPKATSEGTRKPLKRNCKPIIFRQVHQPEPGISITPNKKLDPKATSESTSKPLKRCLKEITSSTAPPPAAKEQKLDGICRVSYAETSFSSDSDNVDDKEEEEELAKKRKEKEEELTRKRKKEEELAKKRKEEKEWVTVYGFNPRDADLVLRELRSCGVILKHVRDLDDGNWMHILFKRRSDAQKALGKSWMKINGGLIVGVKPLDPVDKHKLNEDDLNKQDDLDLRLLHRSAAYFFILGSTGNVYTVRLSRIPTCNCPDSAFPCKHILFVYTRVLNLPYRGGDCTASLLTAVINTKASAPETLASARLRNRFHHLFLMSKVGPQVGPSPPMVKLGDDATCSFDGCIVPFMVNGNQSDSEATEDEDADEDNQDWGIVQCGTCRTVGHKECLAFSSTFRGLKVLTCMICEKECWMGRSVLDSYPNLTANLSDDEGD

SEQ ID NO: 606 - protein, 318 aa, Papaver somniferum
MAQLLSPVCTDLLKFQNPNNQFFSSIKPWRMLTKINSNHLITTFSGSKRRDSRIRAVAEESFSSDAIADDYYAVLGLLPDATPEQIKKAYYTCMKACHPDLSGNDPETTNFCMFINEVYTVLSDPVQRMVYDEIHGYALSAVNPFLDDTSVKDHAFVDEFSCIGCKNCANVAPDVFNIEEEFGRARVCNQSGNIDLVNQAIESCPVDCIHWTSAAQVSLLEDEMRLVERVTVALMLAGMGTSSDVFRMANNRWEKRQSKVLEKARIRMMQQKDANKSETYWNDLWGKPATYETSGIKNKTHQILFFEVFSLPSFISFT

SEQ ID NO: 607 - protein, 146 aa, Papaver somniferum
MVNKDISEWNEHLRKNTSGDLHACRVREPSRWNPLHCDFIKINFDAAFQKENKTMGSGLILIDDAGIFYGAWCILGVAENEEHAEAIASWEAIKWAKRNNSQKLHMEGDCLNVVLAINSNLGSVRWTNNPIIMDCKEMLGSFSSLV

SEQ ID NO: 608 - protein, 306 aa, Papaver somniferum
MEETISTTAEKRCAVVTGANKGIGLEICRQLAINGITVILTARDETRGTRSVEALKGSGLAGVIFHQLDVNDATSVTSLAGFIRTRYGKLDILVNNAGDNGVRLQISEEAMKDMNFRYGDENDEIAKLLEESIEETYERVKQSIETNYYGTIRITEALLPLLQLSNSARIVNVSSVYGQLKFISSETIKEELRNVDCLTVEKLDELMQKFLKDFKDGMLETNGWPVLVSAYKVSKAAINAYTRILARKFPTFRVNAVHPGLVKTDIAFQQGNLTPDEGAKAPVMVALLPSDGPSGFYFDQMEISTF

SEQ ID NO: 609 - protein, 108 aa, Papaver somniferum
MNLMNCKSPDIAYIVSKLSGYNCSPEQENSDALSRVLWYLKYCITFCFIYERYLVVLEGLCDANWIVDSEESKSTSGYVFTLARGFVSGSFSDKHILLNSLWNLRVLR

SEQ ID NO: 610 - protein, 265 aa, Papaver somniferum; identical to SEQ ID NO: 68

SEQ ID NO: 611 - protein, 300 aa, Papaver somniferum
MKHAPVKIPLFVIAIVFLVFAFVGLFHNDENSRLLSPTSFFKLSNSCSSQETKVSHSGTPAKKKTRSNLTSKGSSKVTEVEEIYKTDNEDEDFLENKCDITKGKWVFNNLSQPLYSDQSCPYIDKQVSCVKNGRTDSDYRHWEWQPDDCVLPRFDPKAVLNKLRNKRLMFVGDSLQKNQWQSFVCQVQSIIPAEQKSMQRGRPHSIFTAKEYNSTIEFYWAPFLIESNTDLDIIADPRKRILKVDSVTKHAQYWMGVDILVFNTYIWWMNGIKIKSLWGSSQTETTGLKSWMQKLLIELV

SEQ ID NO: 612 - protein, 271 aa, Papaver somniferum
MAVLNIIKLIFVTGVISGIFTELTAGQNCGCAANECCSEFGFCGPAGDPAYCGSGCREGPCTPPTDVNVADIVTPEFFNGILNQGDCPGKNFYSRGAFLDALSSYDRFGRAGTQDDSKREIAAFFAHASHETERFCFTEEKDGATKNYCNETDIQYPCAPGKLYYGRGPLQLTWNYNYGPAGQENNFDGLNNPEIVANDPAVSFRTALWYWMRSVHRIIIAGQGFGATIQAINGALECGNPAESGKVDSRVNYYTNYCTQLGVAPGDNLRC

SEQ ID NO: 613 - protein, 239 aa, Papaver somniferum
MERIEGLLGPEDNKSRTLSPYVTGTSVLGIKYKDGVLMAADMGGSYGSTLRYKNVERVKPVGKHTLVGASGEISDFQEIMRYLDELILYDNMWDDDNSLGPKEIHNYLTRVMYNRRNKFDPLWNSLVIGGVKNGKKYLGTVSMLGVHFEDDHIATGFGNHLARPILRAEHSNDMSFEDAVKLLEKCMLVLLYRDRSAINKLQISNITEEGVTISQPYSLKTFWGLSAFKDPTKGAQGSW

SEQ ID NO: 614 - protein, 182 aa, Papaver somniferum
MSTTGTVSVQFHPIVKICGSENDKFSVIHPKLEFPRSKFLRFNLCSTDSTRKGCIGRVSAVPEDEDFFWEKALTTLLDMVETPTHMKNLSIKELKQLADEIRSELSFITSKMPRYFKAILATVELTVVLHHVFDSLTDKILWDVVQQETEVTFISNRHASVEVNSMKHPTLDNLARIHLLHL

SEQ ID NO: 615 - protein, 84 aa, Papaver somniferum
MSTGMISSTSIINIEVALSIGDGLRPGSIYDANDTAQFAELLTQEELPLRAWEKDVQVMNEGPGHIPLHKIPENMENKSTRQKI

SEQ ID NO: 616 - protein, 101 aa, Papaver somniferum
MICKAIWARSFTGTNTRKRIENFIPSNGSHQISCIRITHHLSKLNKFSIRVINTRRTSTSNKLEKKEVHSRAISLSSSNITRLEFFKDKILFLHLLSLTEL

SEQ ID NO: 617 - protein, 186 aa, Papaver somniferum
MGYFDIPVDHVYGQPVVLDYLASKNICSDDLVVVSPDVGGVARARAFAKKLSDAPLAIVDKRRHGHNVAEVMNLIGDVKGKVAVMVDDMIDTAGTISKGAALLHQEGAREVYACSTHAVFSPPAIERLSSGLFQEVIITNTIPVLEKNYFPQLTVLSVANLLGETIWRVHDDCSGTSEPYSSLGID

SEQ ID NO: 618 - protein, 790 aa, Papaver somniferum; identical to SEQ ID NO: 551

SEQ ID NO: 619 - protein, 175 aa, Papaver somniferum
IPKFRVSASSSSSTASPPIVPKSNPKKPNTLLSDSITSIFAIGLSLSRIFQGVLNKAPELGGNLVNTAGPLFFAAIRERPKGYLNTPLTVVASGMSKWLDIYSGVLMVRVLLSWFPNIPWDRQPLSAIRDLCDPYLNLFRNIIPPIFDTLDVSPLLAFAVLGVLGSILNNSRGMY

SEQ ID NO: 620 - protein, 262 aa, Papaver somniferum
MDVELPLDKLSLKPIDDGKFVVVLVANGSFNPPTFMHLRMFELARDALNSDGFCVIGGYMSPVNDAYKKKGLISAEHRLQLCELACRSSSFVMVDPWEAKQSSYQRTLTVLGRVQSCLCDSGLVRRESLKVMLLCGSDLVESFCVPGVWIPEQIRALCRDYGIVCIRREGTKIEKIVSGDEILNAYKNNIRVVDELIPNQISSSRMRECISRGLSVKYLTVDEVIDYIRQHNLYLNSEANEKKHLQEGKDEKMMLKKKEISD

SEQ ID NO: 621 - protein, 92 aa, Papaver somniferum
MVMLGSGGTGLSADAVEEDANETNELGQKERPASINDHLTPAERRYIEQRERIDVRRLAKTSNKSHRDRIQDFNQYLANMSEHYDIPKVGPG

SEQ ID NO: 622 - protein, 364 aa, Papaver somniferum
MSSLGRLDLSYNNLQGELDEQLSHWPADVFAGNFKLCGRPLVTQCNTEDTEHVRSRLSTSSVVAITATLTLAGVVILLLVGLILVSRRKHQYLRREDVDGNNAYSSSSSVQRRLLFHNASTAREFRWEDIMEATHDLSDEYIIGSGGSGTNYKAELPSGEIVAVKKILRKDDLFMDRSFAREIQTLGRIRHRHLVKLMGCCSTSKGGGMGCTLLIYEYMENGSLWDWLHRPMTQESTTKKVGINLDWEIRLKIAVGLAQGVEYLHHDCVPKIIHRDIKSSNLLLDSDMEAHLGDFGLAKVLLDDQDSYLVCWILWLHSSRVCLYTESNGEERCLQYGNSTNGTCNRENANCWNFWSEYRHGEMG

SEQ ID NO: 623 - protein, 474 aa, Papaver somniferum
MQRVRIILRFVILNIFVITPYNQKLGFCLNVWFKLNVWFITLQTCLLTMRGGSSSTPTASVSSNKRPPRPPPNASSDGGANSAGGASAAKDASVAGDASADGDATEAVIKVTETHSNKRKTPEDATEDDTEVSQVTEPKGKKRSDVWNHFDMDPKPSKYAKCRHCKTKIAAQGTKYGTGGMNNHLKICKKKPKEEKGQQTLDFQPARLGGEGKLVAATFNQDACTKAVILFVILDEQPFRVVEGEGFKELCRVLESRFKIPSRMTISRGVLNLYEAEKEKMKNYFKENNVRVCLTTDTWTSNAQNKSYMVVTAHFIDKDWKLHKLVINFFQILGHSGEVIGKMLEECLLDWELPGVFTITLDNVSANDLAIDYLREDGHLKEQVISSKGVLNTKFMQVRCAAHVLALVVNAGLGEYHMAIKRVRAVVKHVMSSPARLSKFMDCAKQEKIDCKKRFSFRCGYKMEFHLHDVGSCL

SEQ ID NO: 624 - protein, 225 aa, Papaver somniferum
MATLAYLLDQLATASRLTSTNIGGNFTLLQVWIYDHFPILNLAKVFDKDVDYVDTEPTAARYAYEDSKKRNKKKLVESLRETLDCLGVDDVAFQPYENEDEEDEVVEDEDMPVGMYHGPLWYPGGYVIYDPRRVLRQLGCVQKVPLFDEKFRLLPKSGKGTKITTSSWEPKYDPDPTVEFWNNLDNHTLDVSKLTPLLDDPCEEDPGYMDWYNQISHPFIINKKR

SEQ ID NO: 625 - protein, 359 aa, Papaver somniferum
MNTHQSVLTPVKRSWCNGMTILNIMVVVIILVVQISSTCCLASSQHQNLVRWNHPKRELLDRINRKGPYIGVVMAYSTEEMALQASGVFIPNCHNPSVDLSGRKFNIGSIKGTKVIYVMSGQRRLNAGITVQILLDVFDIRGIVHYGIAGSANNSLSYGDVSIPKYVAFTGSWNWENLGSKNVDKFTEMKIGNYNLPKEGQNLLGEIAFKPEEFFSVGQPMKEVFWLEVDKTWFNLAAQLKCLEFQRCENATSCLPRVPKVEYGLRGATADIFLDNAAYRNFLFKEFQVSTVDEESSAIVMTAMSSNVPSIVIRGVSDLAGGEGTPVSTFLSSLAAVNTLNVTIKFIELIGASRNTLAK

SEQ ID NO: 626 - protein, 855 aa, Papaver somniferum
MGGTSINLVVVVVELAVVVSLLSMRMGFCQEDENSTTSIYIVSLKQTPTVLLNFNNQGLNLEKRTKGFMHRNGSYSRLITKHHRPRNYSRSDRRYAAHISRVHDSLLKRALRGENYLKLYSYHYLINGFAVLVTPEQAEKLSSREEVANVILDYRVRTETTHTPQFLGLPQGAWVQEGGPESAGEGIVIGLVDTGIDPTHPSFSDNLSGNRFSVPTHFTGMCEVTMDFPSGSCNRKLIGARHFAASAITRGIFNASQDYASPFDADGHGTHTASIAAGNHGIPVIVAGHHFGNASGMAPRAHISVYKALYKSFGGFAADVVAAIDQAAQDGVDIISLSITPNRRPPGIATFFNPIDMALLSAVKAGIFVVQAAGNTGPSPKSMSSFSPWIFTVGAAAHDRTYSNSLVLGNNVTITGVGLAPGTDESTMYTLVSALHALNNDTKDATNMYVSECQDPSSLSTDVVQGNLLLCSYSIRFVLGLSTIKQALETAKNLTAVGVVFYMDPYVIGFQLNPTPMDMPGVIIPSASDSKILLKYYNSSLEQDPLADKFKFGATATILGGLKANYSNSAPKVMYYSARGPDPEDSFLDDADILKPNLIAPGNFIWGAWSSVGTDSLEFQDESFAMMSGTSMAAPHVAGLAALVKQKFPSFSPSAIGSALSTTASMHNKKGEPIMAQRAYANPDLNQSPATPFDMGSGFVDVTSALDPGLIFDSSFDDYFSFLCGINGSGPVVLNYTNQNCGNSTINCRDLNLPSITIAKLNQTTTVERVVTNTAGNETYNLSWFAPYGVSVLVTPKRFFIESGQKQVITVTLNATMNSSAASFGRISLYGSQRHIISVPLSVIYKISYNVTENS

SEQ ID NO: 627 - protein, 248 aa, Papaver somniferum
MVQYFFTNHHMLKEIYHTYQVLIQKITHPQTPVEYRPISLCNVSYKIISKILANRLKPFLSNIISPTQTAYVPGRHIHKNVIIAQELLHTMKTRRSKDALVGLKLDMSKAFDRLEWSFLLSIFRNIGFYNDWIAMIDQCIYTKNTSLLINGSPTATFTPSRGIRQRDSLLSYLFMFIMEAFSSLLQSQIDIGHLTGIKVAKHSPTINHLFFTDDCLLIFQANNSHMHHLHKLLQSFGQASGQVINMQK

SEQ ID NO: 628 - protein, 99 aa, Papaver somniferum
MSPKEHEELRRQVEELIAKGFIRPSLIPCAVPALLVPKKDGSWRMCVDSREINRITLKYRFPIPRLDDLLDQLSGACVFSKLDFKMDIIKFVSRWEMNG

SEQ ID NO: 629 - protein, 347 aa, Papaver somniferum
MWVFSEADDKVVKLQDNNKIEEKIIKEEEDEVEKSGEVLFCGGHTDGNLSSPTRLRPLIGVNIRYVAAGCVSFHCVALDVEGRVYTWGKNKRGQLGHGDMINRDRPTIVSGLLGHKIIKAGAGRAHTVVVTDDGKSFAFGWNKHGQCGTGSARTEFQRSPVSSQVSEVTNVVCGGDFTVWLSPVEGSSILTAGLPQYGQLGHGADNEYNIKSCSVKLAYEAQPRPKTIAAFAGKTVVKVACGINHTVAVESKGFVYTWGYGGYGRLGHREQKDEWTPRVVAVFQRKNVLPPNAIVAAGAHNCAVTAGGGQLYMWGKVKVNSEDWMYPQPLLGLRFCDGPYMFSSGSV

SEQ ID NO: 630 - protein, 205 aa, Papaver somniferum
MAEVVSEIPQETMEVETPQNGSETNGDSKRSRENNGVEENEAAKKQKVEEGGDDETEGEEKKSEPVQLGPKTFNTSVEMFDYFYKFLHYWPPNLDVNKYECMVLLDLIKKGHSESDKKVGAGVKAFQVRYHPMWKSRCYFLIREDESVDDFSFRKCVDHILPLPENMKLKPEANKALGGRGGGGRGGGGRGRGGRGRGRGNWNRN

SEQ ID NO: 631 - protein, 259 aa, Papaver somniferum
MILSFFFFVSFFIHILFCSLGSVYFLELQYNSSMAHNTEESFSNNTNNHQAYNMMNITSSSSVDNSPTPTTTKVPSSKFDFVKKLYEEHCPPGFLKKVIAEIIATFLLVFVTCGSAALSNTEDHKASKLGASVAGGLIVTVMIYAVGHISGAHMNPAVTCAFAAVRHFPWKQVPFYAAAQLTGALVASFTLGVVLHPTQNIGTTSPTGTDLQALAMEIIVTFSMMFVTSAVATDTKAVLIPPIFSRKKNFKKKKSLNLL

SEQ ID NO: 632 - protein, 415 aa, Papaver somniferum
MKGYYQASARELIRINGTTKAPVMNYAAETSLGVVTVRAFSLTGRFFDSYQKLIDTDAKLFFHSNAAMEWLVVRVEALQNLTLFTAALLLVLLPQGTVNPGFVGLSLSYALALTGTQVFLARWYCNFSNYIISVERIKQFMHIPSEPPAIVDDQRPPPSWPSNGRIDLENLKIKYRPNSPLVIKGVTCAFKEGTRVGVVGRTGSGKTTLISALFRLVEPTSGKILIDGIDICSMGLKDLRVKLSIIPQEATLFRGTVRTNLDPLGLYTDEEIWNALEKCQLKATISGLPNHLDASVSDDGDNWSAGQRQLFCLGRVLLKRNKILVLDEATASIDSATDAILQRVIRQEFKNCTVITIAHRVPTVTDSDMVMVLSYGNLIEYDEPSKLMESNSYFSKLVGEYWSSCRRSSLQNLQH

SEQ ID NO: 633 - protein, 499 aa, Papaver somniferum
MISSMSEKNMQPSKLLFYLIFTSMFFLILSSIILLQSSSNSFMPRSVFRLIVVNTTSSEYFRRNVNSYSKDTFDRSSLPSSIDTRITEFESSSSHGIGVLGQENAKVCKCNQSLLKVYMYDLPPEFHFGLLGWKGEGNQVWPDVSTLDQIPRYPGGLNLQHSIEYWLALDLLASTTPNVARPCSAVRVQNSSLADVIFVPFFSSLSYNRQSKLHGKKEKVSVNRQLQDKLVEFLMSRPEWKKEGGKNHLIVAHHPNSMLGVRRKLGSAMFVLADFGRYPAEVANLDKDIIAPYKHIVRMIGVNNSAPFEKRPILAYFQGAIYRKDVGVIRQELYYLLKDEKDVHFAFGTVRGNGVHKASEGMASSKFCLNIAGDTPSSNRLFDAIVSHCVPVIISDEIELPFEDVLDYSGFCIFVQTSDAVKTGYLVNLLRGIKRKKWTKMWNRLKEVAPHFEYQYPSVSGDAVEMIWEAASRKMHSARLRLHKTNRYKRYQLMGMVKK

SEQ ID NO: 634 - protein, 203 aa, Papaver somniferum
MAEVVSEIPQETMEVETPQNGSETNGDSKRSRENNGVEDNEAAKKQKVEEDETEGGEEKKSEPVQLGPKTFNTSVEMFDYFYKFLHYWPPNLDVNKYECMVLLDLIKKGHSESDKKVGAGVKAFQVRYHPMWKSRCYFLIREDESVDDFSFRKCVDHILPLPENMKLKPEANKALGGRGGGGRGGGGRGRGGRGRGRGNWNRN

SEQ ID NO: 635 - protein, 405 aa, Papaver somniferum
MPDRLSRIAVLNPDRCKPNKCRQECKKSCPVVKTGKLCIEVTSSSKLASISEELCIGCGICVKKCPFEAIDIINLPRDLDKETTHRYGPNTFKLHRLPVPRPGQVLGLVGTNGIGKSTALKVLSGKLIPNLGKFDNPPSWQQILDYFRGNELQNYFTRMRNEKLKAKCKRQYLDDIPRMVKGNVGQVLEQNDERNVKEELCLDLELNQVTDRNVGDLSGGELQRFAIAAVAMQSADIYMFDEPSSFLDVKQRLKAAQVIRTLLRPNSYVIVVEHDLSVLDYLSDFICCLYGKPGAYGVVTLPFSVREGINIFLAGFVPTENLRFRDESLTFKVAETPEESAEEIQSYARYKYPTMSKTQGNFKLQIMEGEFTDSQVVVMLGENGTGKTTFMIYPQASMPSRSFIL

SEQ ID NO: 636 - protein, 265 aa, Papaver somniferum; identical to SEQ ID NO: 68

SEQ ID NO: 637 - protein, 300 aa, Papaver somniferum; identical to SEQ ID NO: 611

SEQ ID NO: 638 - protein, 77 aa, Papaver somniferum
MLADYGIDTGIMKIFCDNSSTIRITENHVEHSRTKHIDIRNHFIRDLYENGIINMEFVPSEQQLTNILTKPLDTATF

SEQ ID NO: 639 - protein, 328 aa, Papaver somniferum
MTMVSQEAIEKLLDLMEEVEEPLKKSFQNMHQGYPNESLVRFLKARDGNVYKAHKMLIDCLTWRVENEIDKILTKPIVPTDLYRGVRDSQLLGLSGYSKGGLPVFAIGVGQSTFDKALVHYYVQSHIQINEYRDRVVLPHATKKCERYIGTCLKVLDMTGLKLSALSHIKLLTVISTVDELNYPEKTDVYYIVNAPYIFSSCWKIVKPLLQERTRKKIQVLQGSGKEELLKVMDKESLPHFCRREGSSLRSNPSNCFSMDHAFHQQLYHYIKQQSMRSPTKQRPFHVTLPEPNSEEKYIAKTIEHEFHNFGKRNGLSHSFEGLEINVE

SEQ ID NO: 640 - protein, 437 aa, Papaver somniferum
MASSSNRDEPLSFMNPSSSSSPIQVSDYLGVEGLNSQIGSASGSFQNEGFLTTGGGDAGSGSNSDIEFGFLRPEFGQTSLVGSVQIYDRHVFLCYKNPQVWPPHVEAAEFDRLPRLLCASLLARKAEMKKQTRLTICEGHDGTETSNGDILIFPDMIRYRRLTHFDVDTFVEEVLVKDNEWLPGTPEALSGTYVFVCSHGSRDRRCGVCGPALIARFKEEIDLRGVQGVSVSPCSHIGGHKYAGNVIIFSRNSDGMVSGQWYGYVAPDDVPLLLEQHIGNGEIIDRLWRGQMGLSVNDQKRDQELRLQLNNKANYENIIREPVDDYEVEPNGTSYETAGCCQGNESSSCCQVPERIERNNHVVNEEVKFPKEKKIKKGTDKKLLRTSSGKGTTSTRKVCAMPTWFESWEREDTYAALAVVGAFVSVAIAYSSYKQLR

SEQ ID NO: 641 - protein, 671 aa, Papaver somniferum
MGKKTYDSPKDSPRMEVGEIDTRAPFASVKAAVSLFGEAAFSGSGEKPVIKKSKLPSTERVLVKETQLHLAQKELNKFKEQLKNAETTKAQALNELEKAKRTVDDLTQKLKTINESKESAIKATEAARNQAKQLEEATAGNSLQSNAAWEHDLDSAREQYTLALSELNVAKQELTKIRQDYEVSMEAKAAAFKQAAEAENSAKANTERASEISKEISAAEESLVDVKHAAMQAQQERVNILSGKEAQRQSYASALKEAENKLESFKKGFDPTLPGSLEAKLAETDAEIGALKKEMENAKASDLDSVKFVTLELDDAKESLQKVAEEENSLRSLVESCKTELEKVKKEHSELKEKEAVTESIAGSLHVQLRICKAELEAALAEESKAKDASDELVTTIQQLSLESENARTEAEQMKKNVEDLKKEAEETRHALEEAKKKLETALNEAEEAKAAETKALGQIKVLSERTNAARASTSESGAKITLSTEEFESLNRKVEESDVLAEMKIAAAIAQVEAIKESEKEAQRKLETNWKEIEEIKVATEEATKRAEMAEMAKKAIEGELRRWREREQKRAAEAASRILAETEAASSPDSSPAPPFQPKLMKKQPSEKKSSPVNEKFQKAFSEKISKSRKFDKNNGSKKLLPSLSGIFHKKKNQVEGGSPSYLPGENPV

SEQ ID NO: 642 - protein, 115 aa, Papaver somniferum
AIPTLDEVKEAVFDLGADSAPGPDGFTGSFFRICWNIISRDLFNAIANCWAMSKIPNGINSSFIVLIPKTNKSDAIKDYRPIGLSNFFFKIITKIMATRLGTVLNKLISEEQVAF

SEQ ID NO: 643 - protein, 142 aa, Papaver somniferum
MSFSSTCCSQMNCRFGTSELFSPCFALGRFPFLSCMLSRELASWFCLLELHLPNKEILLDDNKLKDNKTSMDTKFSNYFVPVLPSVTECNIIMQGVMMTHGNIVSTAAAVMTVIPEIGRKDVYLAYLPLAHVFELEAEVLTC

SEQ ID NO: 644 - protein, 678 aa, Papaver somniferum
MDAPNDGTFYKPFVGMEFDSLDESYFYYNEYARAVGFSIRRAKNRRSNIDGALIFQRFCCSKEGHRRKRRDNDDEEPKKMKDGVLVKVRRRNVRSIRVGCSAKLDVKRVTDGKWVVRKFDEEHNHECANSGEKHMLRSQRRIQSIQVDMSMSDCKIKKPEKGDVRALLNYFREMQTESPSFFYAIQGGKDDRMLNFFWVDTRSRMDYGYFGDVVYFKSNYGINKYGRAFSPILGINHHLQTVLFGCAILLNENEESLTWLLETFLKAMSGRRPVAIVIDGDAAMMKAIEQVLPGTRQSLCLGEILVDASNHFSHLENMRDAFITDLKKCIYDTQWCDEFESSWVLLHEKYKLHENEWLDNLYKKRHMWAPVYSRHVFHANMMTIQCIESINSYFDGFVNEPLPLYEFLKQYDKALDHRRDEEISEDFQSLETRPVLKLDVPMEQQAADLYTRSVFKEFHKEFCESFSYIAEETARVGTNWTYAVSRWGQNRSCLVSFSSCNNDIRVNCDCQNFEFTGILCKHIFKVFTVRNIMLVPDVYIRKRWTKKAKVGVFLGEGCRKALEDCQKSQAFRFNDLCQLTFNLCAKSAISINAYQTAKSTMEMIIGELDKEAEEEVSITQPNIDHVSNLHYPIDAVNGIGSSDHLMGEDNQTLTSGNHVTMQNPQRVGDTRTGFWLRL

SEQ ID NO: 645 - protein, 168 aa, Papaver somniferum
MDISSDLTELGRSPVAVISAGIKSILDIPRTLEYLETQGVTVASYKTHEFPAFFTETSGCQVPCRVDSPEDCARLIDANLKLGLGSGILIGVPIPKEHAASGRMIESAIQTALKEARDKNVSGNAETPFLLAKVNELTKGASLASNIALVKNNALVGGSIAAALSKLR

SEQ ID NO: 646 - protein, 306 aa, Papaver somniferum; identical to SEQ ID NO: 608

SEQ ID NO: 647 - protein, 211 aa, Papaver somniferum
MECLSSKFIPFALLAILSLLQVAVGIRFVIDREECFSHSVPYEGDTVHVSFVVIKAEGWHYGDDGVDLVVKGPTEEQIHDARDKTSEKFEFVAHKKGVHKFCFTNKSPYHETLDFDIHVGHFTYFEQHAKDEHFNPLLEQISKLEEALYNIQFEQHWLEATTDRQALVNEGMSRRAIHKAIFESAALVGASILQVYLLRRLFERKLGTSRV

SEQ ID NO: 648 - protein, 318 aa, Papaver somniferum; identical to SEQ ID NO: 606

SEQ ID NO: 649 - protein, 524 aa, Papaver somniferum
MGSLPTDNPESMSICLQNPLDPDEFRRQGHMIIDFLADYYKNVENYPVRSQVELGYLRKRLPESAPNDPESIETILQDVTNDIIPGLTHWQSPNYFAYFPSSGSVAGFLGEMLSTGFNVVGFNWMSSPAATELESIVMNWLGQMLTLPKSFLFSSDGSSGGGGVLQGTTCEAILCTLSAARDKMLNKTGRENINKLVVYASDQTHCALQKAAQIAGINPKNFRAISTSKATNFGLSPNSLQSTILADIETGLVPLFLCATVGTTSSTAVDPIGPLCEVAKLYGIWVHVDAAYAGSACICPEFRHFIAGVEEADSFSLNAHKWFFTTLDCCCLWVKDSSALVKALSTNPEYLKNKATESKQVIDYKDWQIALSRRFRSMKLWLVLRSYGMANLRTFLRSHVKMAKHFQGLIGMDNRFEIVVPRTFAMVCFRLKPTAIFKQTLVENDYIEAASNEINGKLLESVNASGRIYMTHAVVGGVYMIRFAVGATLTEERHVTGAWKVVQEHTNYILGALDGHTTNHQIVA

SEQ ID NO: 650 - protein, 379 aa, Papaver somniferum
MEGTSVGTPSRVSLLNASALKCRNNFMVTRSIPGYLFENTRRRNDSIKRVLSQESEGGASVASSSSSSSVDDQGIKIRRRPTSGPPSHAVGPFEFRLQNDGNTPRNILEEIIWNKDVEITQLKEKKPLYSLKKALDSAPPVRDFVGALRSAYLRTGAPALIAEVKKASPSRGVLREDFHPVNIAQAYENGGAACLSVLTDEKYFQGSFENLAAIRRSGIKCPLLCKEFIIDAWQIYYARTKGADAILLIASILPDADINYMSKIAKKFGLSTLVEVHNESEMDRVLRIDGIDLIGINNRNLETFEVDISNTKKLLEGKRGEIIRQKDIIVVGESGLFTPDDIAYVQEAGVKAVLVGESLVKQSDPGRGIADLYGRNISS

SEQ ID NO: 651 - protein, 74 aa, Papaver somniferum
MPADYSSISSLIKKSRNDEENQTRVSVATMSLGDENSHEIDGDLHSRQLVVYGRETMRRLFASNILVSGMQGIG

SEQ ID NO: 652 - protein, 318 aa, Papaver somniferum
MVMPFGLSNAPSTFMRIMNQVLRPLIGTFVVVYFDDILIYSVDMNMHFQHLREVLPTLRREKLFAAIKKCSFMTDQILFLGYVVTKDGIKVDYSKVEAVRNWTTPTTLHEVRSFHGFASFYRRFIHHFSTIMAPITECMKVGKFSWSEEADKAFEAVKTKLITAPLLVLPDFSKPFELHCDASKVGIGAVLSQEGRPVAYFSEKLNGAKTNYSTYDVEFYAIVQALKHWRHYLIHNEFIMFSDHDSLRHINRQEKLSSRHGKWASYLQEFTFILKHKAGSQNQVADALSRRSMLLNTMRTEVIDFDSYSEHILTNPHF

SEQ ID NO: 653 - protein, 77 aa, Papaver somniferum
MTIDKTLPLQTSTNNTNVPKNPASINQKGKTIEEMYQKKSQLEHILLRPDTYIGSIEKHTQSLWVFEGGQMVYRPVS

SEQ ID NO: 654 - protein, 169 aa, Papaver somniferum
MSGIEESVAPPPPQDVSSFSKGAVTVTPTIFPNMKKLHLNDINGSAVSSILTNLTSLAHLSITEVPELFIQQGLFGNNNLLESLSVRRCTDFQGFCSLEEEKEPISTFHLNNNSLKELEFIDCPDLTFLLDIRGCTSLQKITINGCKELKFEYDLRTCLSFIPELDIPF

SEQ ID NO: 655 - protein, 401 aa, Papaver somniferum
MYVLATDIGSLQNLVSVRFQHTSIKELPNSFGELTKLRSLSLEDTDVKELPESLSSSICKLEFVNFGRVCKFPKDIKKWVDLRCMRKSNRFADQYQVMPTGIEMLTRLEVLDSYVVRNEKDYIGGYYDSSRIEELAGLNTLRELTITHLHNVIGKMDAEGAKLKDKMIIKKLYLKWVQKRKEEEEVADSSFMVLEGLKPHSNLELLSIEYFGGVKLPKWMSSSYCLPNLVKLFFKDCKSCEKLQSLGMLRCLCILHMIGMSSVKCLGVEFYYQQGEEEESSMTTLFPSLIELRIHYLNDLEEWVAPPPPYSSFPVLEYLSIQRCPKLKSIPDLGLRTSLQRKILECNKLEESMPCDPKNPSCLEFLDELSRGNFIDFNDPKNGVPSDLEKRKEVGDRCAPM

SEQ ID NO: 656 - protein, 790 aa, Papaver somniferum; identical to SEQ ID NO: 551

SEQ ID NO: 657 - protein, 386 aa, Papaver somniferum
MNNIFAKLRNLDAYPKINEDFYSRTLSGGVITVISSILMILLFISELRLYINSMTHTELVVDTSRGETLRINFDVTFPALPCSILSLDAMDISGEQHLDVKHDVIKNRIDANGNIIETKKDGVGVHKMEKPLQKHGGRLEHNETYCGSCYGAETTDADCCNSCEEVREAYRKKGWGMSNPDEIDQCKREGFLQKIKDEEGEGCNIYGFLEVNKVAGNFHFAPGKSFQQSNVHVHDVTAFQKDSFNISHKINKLSFGESFPGVVNPLDRVQWTQKTPTGMFQYFVKVVPTVYTDINNHTIQSNQFSVTEHFRHAIVGQPHSVPGVFFFYDLSPIKVTFTEQHVSFLHFLTNICAIVGGMFTVSGILDSFIYHGQKVIRKKMEIGKFS

SEQ ID NO: 658 - protein, 324 aa, Papaver somniferum
MAPKPSKAEKKIAYDKKLCKFLDEYGQILVVAADNVGSNQLQNIRKGLRGDSVVLMGKNTMMKRTVRLHAEKTGNNDFLNLIPLLVGNVGLIFTKGDLKEVSEEVSKYKVGAPARVGLVAPIDVIVPPGNTGLDPSQTSFFQVLNIPTKINKGTVEITIPVELIKKGDKVGSSEAALLSKLGIRPFSYGLVVLSVYDNGSVFNPEVLDLTDDDLVEKFYAGVSMVTSLSLALSYPTLAAVPHMFVNGYKNVLSVAVASEYSFSYADKVKEYLKDPSKFAVAAAPVAAAAASGGAPAAASKAEEKKPEPEEESDEDIGGLFGDDD

SEQ ID NO: 659 - protein, 262 aa, Papaver somniferum
MDVELPLEKLFKEPIDDGKGVVVLVANGSFNPPTFMHLRMFELARDALNSDGFCVIGGYMSPVNDAYKKKGLISAEHRLQLCELACRSSSFVMVDPWEAKQSSYQRTLTVLDRVQSCLCDSGLVRRESLKVMLLCGSDLVESFCVPGVWIPEQIRALCRDYGIVCIRREGTDIEKIISGDEILNAYKNNIRVVDELIPNQISSSRMRECISRGLSIKYLTVDEVIDYIRQHNLYLNLDLTEKKHLQEGKDEKLMLKKKETSD

SEQ ID NO: 660 - protein, 161 aa, Papaver somniferum
MCVLQSEDGHIMDAPWKSQIDSFPALNINLTQTYIPIHSQALNHTLIHDCTSSFNKIHGSNIFFFTTDLAIKNQPKLSQIRIPLKPNSYFFLTLNPSLQILSIHLLFHFCSSSNSWQYIAGNEQFDQSITSPDPWQMSLEQWLAGVEYGCSADTLVVRKKS

SEQ ID NO: 661 - protein, 108 aa, Papaver somniferum
MSSWKKRQRKRLFKQFLGPYIWRLTVVLIMEKSPKKKIPRMMNLWKILIMIVLLTQLMIIMIILLFKRKKSSLETLQLLMVRLMLCMRAMMIMTSLCSLPQIQKSSIL

SEQ ID NO: 662 - protein, 179 aa, Papaver somniferum
MSNHRTTRERGIPHGRDEVLDEQRPGRSNSRRAEDARDDHQSHDHHNGSYYDRYVPEDDDYYLIDQDRRARPSHKRHDGHRHRVGHDDNDYSKKTRRERDYRERRTELVRNERIRRETDGDSPRSNHLSKKKIDEMIEEALSHKQSKDERQQILSMKRSMDSPFTNRIKQFRPPLNFIL

SEQ ID NO: 663 - protein, 386 aa, Papaver somniferum
MLSDAFFEQYKINLGNKKGRSHFFLLHREAGESLIDFTRRFRQEVSEVGKVDAGLVIEAYKNALDYDELEIYNSVTVQPVGTLKELYDRADRYGGAEKEKRAKLSRMTKAPCAEGHGKQKQHLESSSKKKNHDDPRSRAGDGEELRKAQGKVKIRFPSLNIGLGELFKKIKDSLPVPKPMSEQIKDKRDKSIYYAHHRDHGHNTESCRTLATEVQKMIDEGKLQQYVKKNPSQVNTLDLREIRVSHARVNSTSRKAHENATRLKLRHIQDWRISNKVDYANLIGTETLEKGKIEICFSVADLAGVYQPHNDAIVILALIGMYKVRRVLVDTGSSISVIFSGAYTSMSLNESQVEADDNPIIGFSGEIMTTIGRVSLPITGGGKTVM

SEQ ID NO: 664 - protein, 124 aa, Papaver somniferum
MTRTTHVDSWWWLRRCPPNEIQYLLRTCQSLLKGKYIKFVEEADGISTTQEKDFLKLMKLKYFISLAQPGELVGVLAAESVVEPSSKMTSDTFLIFSFFFIYHHVRAFLVDREMAKSSGVEYIT

SEQ ID NO: 665 - protein, 317 aa, Papaver somniferum
MDIDDMDNGQSEDWRQSYVRYLRCVTRDEGMKLLAETHEGCCGNHSGGRSLAHRLLSQGYFWPYMQNDAKEYTNKCVSYQMHGPLIKRPANELHPVMSAWPFSKWGLDTVGPFPAAPGGVKYLLVATNYFTKWIEAVALVKIEAVHVRRFNWENIVCRFGIPATIVSDNVKQFDSGVLWAYRTTPRRSTGFSPFTLAYETKAVLPVELLVPTTKSLAERSGLNSGILSKDRELLDEVRDEASRRLAIYQQSMKQQYNKKVRERSFLPGEQVLVEKLASCGAYWLRNMSGKMEPKPWNSFNQLAEMLAIETPSFWKYN

SEQ ID NO: 666 - protein, 300 aa, Papaver somniferum
MLEARIIKPVRYPKWLANIVAVPKNNGKIRVCIDFTNLNKACSSDPYPMLRIVDLVDSTSGYGRLSFMDGFSGYNQIPLFGDDQEHTSFITDKGVYCYLVMPFGLKNAGATYQRLVNEMFKDMIGKTVEVYIDDMVVKSKQKESHLSDLKRTFERLRQYGMKLNPAKCSFGLTSGKFLGYMMTQRGIEANPEQIRAIQEMPSPRSVKEVQRLTGRLAALSRFISRASDKFRSFFQILRKAEKFGWSDDCERALNEIKRYLTSPPVLTIPKTGQTIYIYLASSEFDVSAVLFVREPWRIHH

SEQ ID NO: 667 - protein, 221 aa, Papaver somniferum
MSQESFIYSFVARGTMILAEYTEFTGNFPAIATQCLQKLPSTNNKFTYNCDHHTFNFLVEDGYAYCVVAKETVGKHVSIAFLERVRADFKKRYGGGKADTAIAKSLNKEFGPAMKEHMCYIIEHADEIGKLSKVQAQVSEVKSIMIENIDKVVDRGEKIDILSEKAADLNSNAQEYKKKGTQLRRKLWYQNMKIKLVVLAVLLILVLIIWLSVCKGFDCTN

SEQ ID NO: 668 - protein, 129 aa, Papaver somniferum
MCVSSNVWHGRLGHVNYKSMHKLASVGCILKFTLDKSHKCEICVESKHAKKSFRKNVQRNTKPLELIHSDVVDMKSVQTRGGKKWFVTFIDDCTRYCQDYLLRGKDDALEAFKIYKREVENQMNATIKT

SEQ ID NO: 669 - protein, 422 aa, Papaver somniferum
MGKNDVERPQKFNGKDFKRWQSKMLFYLSHHELDYVLVPHAELMNAEGLTEEAIEYNKRCNFLAKNHIMNGLEDAMYDFYNAKENFSAYDLWTALEAKYQAETAGSKKFLVAKFMDFKMTNDKPVVDQFLEFQQIINEILAEGMVIDETFQVSAVIEKLPSSWSEYKKKLRHETGEINMVELGKKIQVEEMLCTKDKNVSSARDMSNKAHMTEHRSSKAGKGESNNRNSKRGPPKKGMFRKPESSITKIKGACYACGVTGHMAVHCRHRKDKKDSANLVEKNKDEFSAVVSEVNLVTNVMDWWVDSGATKHVCGNRDLFTSYQRVGEGEKLYMGNSSASEVAGKGKVGLKLTSGKTLTLNEVLHVPDICKNLVSCSVLDDKGFKVSIESGKLIVTKGNDYVGKGYKTGGLYKLNVTCPEVKL

SEQ ID NO: 670 - protein, 294 aa, Papaver somniferum
MTKTRMTCGEKPCSILFSMAPAGHAKDIPILISDDDEMEHDSPSYSPATHSNYHFDANQMTQQPMTATSLNHPTIDDPLNGAIKANGSVTATQSNDYCNANPPINATEEKYPFNADIFIPIPIKRNDNPMTHEDSAILDPFVARGLIDTSMLPVDRGLFDWIDDTCVVLDKVKQCSFEMQALLRRSQILHMQEVTGKDARIAGLCATIAEKNARITKLRDTLVDRNLELYQKEQWLFEEYTRNEKLEMESKDVVGIEEELRITKEKLKEAAEFAYNYDPEDDDYEPEEISSKQE

SEQ ID NO: 671 - protein, 272 aa, Papaver somniferum
MKAARLIVFPIKGRNWCFSRSIEQTVQESEATKPSPKFKDLYKKITSKGKPMNQNVEIITEFFSTKMNKAWAGLGEAPEGSIKNKIHGLGVKLLARVKPSEIFLKSISKDVTNVEITYPTSLNPRLVRRRLRHIAFRGSVIHRRYFYGSVSLLPLTAACAILPLPNIPFFWTLFRTYSHWRALQGSERLLVLVSDGSTTVKEQKRDSDDEDEQEHKSLNAPIPQWVLHPSEDLDKYLQDLDEKDGLSKSVVSKICKAYHLDTQEVDKYRCSV

SEQ ID NO: 672 - protein, 457 aa, Papaver somniferum; identical to SEQ ID NO: 106

SEQ ID NO: 673 - protein, 579 aa, Papaver somniferum
MPLLDIATSQPTFGNHFCTSSRYQTLLHGNTTSVKLVNFGKEKRLFSTWEVSIQMPTKIRFDMGGNRRGRALLIKAVATLEPKYLVQSAEDRSANLELGSEAASSQYPGEEDEAEVDERERLRRLRISKANKGNVPWNKGRKHSAETLRRIRERTKIAMQNPKVKMKLVNLGHAQSEETRNKIGVGVRMGWQRRREKLMVQETCCFEWQNLIADASRRGYAGEAELQWESYEVLDEQLKREWLESIEQRRMAPRPKGSKRAPKSLEQRRKISEAISAKWADPSYRERVCDALNKYHGIPEGRERKPRRKPSGDRNAARRKAYSEAESDAKSRAKPKKSRAAPYKDPLADSKLEMIRNIRAQRAVTETKKTEAVERAKLLIAEAEKAAKALEVAATKSPLALASLMETRKLIAEATRSIQAAESGQISYVGNKKDSSPFDLNEDLVGDETGEQDGTVPSPDQKEVNGTHVYSDAISDFEFGNFDLEGMLDDDELLEMEGLDDDDDDFVPAQVEVNGYSHKLDPKSELAVPVEEMQEAIKSQITTQEVPVSNKAEKTSVRSNNTTVKKKWIRGRLVEVEED

SEQ ID NO: 674 - protein, 221 aa, Papaver somniferum
FKSRCYIGGKICKMIIDSGSVDNYIADHVVKKLELPVTSHPEPYTVGWVNASSTQNITLQCYVSFSFEGYEDTVLCDVINMTTTHLLLGRPWQYDLHAVHNGFENTYTFVHNGKTKVLRPSNSTSNSCAQTDAVVATVIRSLHPQHSLHSHEDSKPMIELPAKVKPLLFQYNVLFPDELPTALPPLRNIQHCIDFIPGASLPNQAHYRLSPAEHEILQGQV

SEQ ID NO: 675 - protein, 790 aa, Papaver somniferum; identical to SEQ ID NO: 551

SEQ ID NO: 676 - protein, 151 aa, Papaver somniferum
AEPSSAVDLETKSTVAKTAKGKGKAVAVDVTEKRRKSKSNSEAKSQIRRPRKRTDGPLKKLKSVISKGKKKVGVKEEDDEEVADLVIDNPEEAVDEEEEIEDVLVEKKKRKINKSEKQKEDCRLIGEPVPVEEARQRWPHRYDAQKIREEI

SEQ ID NO: 677 - protein, 345 aa, Papaver somniferum
MDIVKFLQPKFTLMENVVDIMRFLGGTLGRYAMGRLVAMQYQVRLGLLIAGSYGLPQFRMRTFLWGAKMTEKLPQFPLPTHKVIARGFSPKEFERNVVKGNEESTLQLKDALVLKDAIFDLPEITTHEIQDERDYGNDIHTTDLTDFQKMIRLPKHKLMGSAYPEESGTLKLFDHRPLKLSEDDNLRVSKIPREKGANFRNLPGVIVDGNKACRDPKMAKVMIEKSKKPLVPEYAIKFVRGTSKKPFGRLWWDEIVSTVVTRAEPHNQIILHPEQDRVLSIRENARLQGFPDFYRLFGTVKQRYMQVGNAVAVPVGKALGFSLAKAVNNTSGSGQVFELPPSFSR

SEQ ID NO: 678 - protein, 104 aa, Papaver somniferum
MSMQSLKDWPDTSVAAEPGICMPYTNQYIQFQIHILVHSQFHNHFKIISPNPYFLQHLIHSGHPITPTVSSTQTTPPFSSYQHHQYTVHASHTILSLRRTITSR

SEQ ID NO: 679 - protein, 670 aa, Papaver somniferum
MMNFGVTQKGGGSGFPVIPKSLASIVVSVGGLALFVIFASWLLISNPASTPVNGSSLFSISNNSTKSGFDSSPLVGLDNNNETVTLLTQKPPSDSVDDEKLPSISSDKIDSDASGEIKEKGVETGPIDNKSPDVSSDKPEEILPKDSDKIDLGEKGKQEITSNIPEEIPVPSPPLSDVTSKIDSGEKGVEAGGDDKITDSEFPSTTKKEITVPSPPLSKDLGEEGVKQELSDSTSHTPEEISVPSPPVSILSNETDTGKKGFETETDTGNKGFETEDNGGVSGSESPSKTEEEIPTPSPPLSKDSSKTASGDCDLFHGKWFYDPEGPLYTNNSCPVITQMQNCQGNGRPDKEYESWRWKPSQCDLPRFDGKKFLELMRGKTLAFIGDSVARNQMESMLCLLWQVEVPKNRGNKHMQRWYFRSTSVMIVRIWSSWLVGRSAEPVDVAPASVVKLHLDSPDEDFFQYLPSFDVVVLSSGHWFAKQSVYMLNNEVVGGQLWWPDKRRPMKVNNIEAFGISTETILTAMSTYPNYTGLTIVRAFSPDHYEGGAWNTGGSCTGKVKPATELVENGFTNIMHEKQVTGFKRAVEKSKNGSKLRLMDITEAFGYRHDGHPGPYRSPDPNKKTKRGPNGEPPPQDCLHWCMPGPVDTWNEIVLEIIRREFEDNVTSPA

SEQ ID NO: 680 - protein, 149 aa, Papaver somniferum
MECYHFHHNHTITSLLPFPYSNHCSISKFHKHQLHPCFNKYNILKSSKKILPQKQTQKSSSSSNYASLVSSLPSAIQTHEPQNSVLSRTLNSITIIGFHPLKLIFICNVTPNPQFTHYPTRINLLEHRFHLSIVSLNFNETLTLQLNTE

SEQ ID NO: 681 - protein, 418 aa, Papaver somniferum
MPMYDYIYGTMDKSSDDLYETSLKRTEESPDVVHLTHPTTPDSIYHLRLGFASLASKPYMREANNKHYFIIKWILWPLTFLWSVLFQRMLSHTFVLERNIFDDHQVTKKLLQVQTWAIPRYSYQYKRLTRQRGTINSLIEKAILDADKAGAKVISLGLLNQGEEMNRNGEVYIQKHPNLKIKIVDGSSLAAAIVLNSITNLKTQQQVVVMMRGRLTKLACYIALALCQRGIQVVVKLQSTDDFEKLRSRFFSTSSASQASLLAANNLIPSTKYSAHGNRQVWLVDDEFSSEEHMSAPKETIFIPYSQIPPWSNFKKNPIGAANILRKDCVYYSTPAMMIPSSLENVHSCENWLPRRVMSAWRVAGMLHALEDWEGHECGNWFIKENDNMIDKVWAAGLRHGFRPYYLPVPCTSAVIAA

SEQ ID NO: 682 - protein, 182 aa, Papaver somniferum
MHPWKAPGPDDFPLGFFQTQWGTTKEDVIQMIQSLFTSGRMLRKMNKTNLCLIPNIQLPQAPGDYMPIDLCNTTYKLITKIMAMRLKPLMNKLISPMQASYVPGRQIGDNITLAHELIHWMKRKKTKMGYMESKLDMFNAFDQVEWSFLPKVMETFGFADHFCDLIHECISTKKIQIMLNGS

SEQ ID NO: 683 - protein, 111 aa, Papaver somniferum
MAMSKSRNRFVFVRYFPMAMSKSRSLTQCAAKMSKSRNRFVFVRYFPMAMSKSRILTQCAAKTIRRKLKWIHKLVVTVTFLFAILKYISHIWIRLFMVEVHFSYVSVYKYN

SEQ ID NO: 684 - protein, 649 aa, Papaver somniferum
HTFFGKAAHLVDSTNQVGHFQKVLTSIGNFCICSIAVGLIIEIIVMFPIQHRPYRTGINNLLVLLIGGIPIAMPTVLSVTLAIGSHRLSQQGAITKRMTAIEEMAGMDVLCSDKTGTLTLNRLTVDRSLIEVFNKNMDKDTVVLLAARASRLENQDAIDTAIVNMLADPKEARENITPVHFLPFNPVEKRTAITYIDAEGNWHRASKGAPEQILNLCQEKEQIAGKVHAIIDKFAERGLRSLGVACQEVPEKSEASPGGPWTFCGLLPLFDPPRHDSAETIRRALHLGVCVKMITGDQLAIAKETGRRLGMGTNMYPSSALLDRNRDDHEALPVDELVEQADGFAGVFPEHKYEIVKMLQEKKHICGMTGDGVNDAPALKKADIGIAVSDSTDAARSAADIVLTEPGLSVIIHAVLTSRSIFQRMKNYTIYAVSITIRIVLGFVLLTLIWKYDFPPFMVLVIAILNDGTIMTISKDRVKPSPKPDNWKLNEIFATGIVIGTYLALVTVLFYWIVTATTFIQTHFHLRTLSLTNGEVSSAVYLHVSVISQALIFVTRSQSWSFVERPGILLMCAFVVAQLVATVIAVYANVSFASIHGIGWGWAGAIWFYSLLLAAEPGICCLIERRLSLLRKITGRKIEKQSGFFLKDY

SEQ ID NO: 685 - protein, 132 aa, Papaver somniferum
MYNVKNPIIIDQNYCDQDDPCDEQESAVQISDVIYKNITGTSASEVAVYFDCSKNYPCQDIVLQDINLVRDEDGKAATSSCKNVKLTQVGKVSPGCSRVQLKEWFLKRIEEEEEKEEDIFHGHDQVVYYTDH

SEQ ID NO: 686 - protein, 296 aa, Papaver somniferum
MAPQKNVFSNILFSIVLIFILCNNSYCCRGGATLTSLDLHPTDEQPSDSNNEQGEILRFRGINNGHIKVSAKRMMSVADFGAKGDGKTDDSKAFFKAWKKACSSKNAIELVIPKKKNYCLKPATFKGPCKSNITIKIDGAIEASADRSDYKRDVRHWIIFKKIQNLVVEGDGTIDGKGDIWWKNSCKINKSRPCTHAPTALTFKECNNLTVENITIKDGQQMHLSFQKCMKVEAHNLLITAPEKSPNTDGIHVTRTQNITIINSVIGTGDDCISIVNGSRNVQATNTTCGPGHGIR

SEQ ID NO: 687 - protein, 172 aa, Papaver somniferum
MPHVYQATSAKCAFRVCSDQKREFLSKFHSPVRRALLVITQIISPLKIRNCKTLISPSPPSIFRFPQFQILSQVLQIDPCNKFPHKFQFLFLIFDLPPNQNPNKWSIHFVIWDFGGGIGTHKDNHSMMIFPLKTEPYEFMEAGIRIKAFCCCRNSSRKLCLIDFINQVSNCE

SEQ ID NO: 688 - protein, 191 aa, Papaver somniferum
MDLKEQNDLLIDLESGGSEEEAVILIVNNKEQQQEPIASKARNLLDKAWNGIITSSIDVITGGGGEDGKNAVANGDLENGGEVVEKRCLLQGGGGGEDTLSPLLVVKKKEKKSKTKVSAPKPPRPPRGPSLDAADQKLIREISELAMLKRARIERMRAHKKMKASKAASSNSNMYAMIITVMFCLVIIVQV

SEQ ID NO: 689 - protein, 592 aa, Papaver somniferum
EKEGKEKGKDVDERPAYMDDFDDDFGQYMKGEHDVDLFPEEEVFTPVDPSKMEVKTRFANKEAFKKHLRGYCVLNKCQYILDRSAPSRIKAECRFKTEHDCPWFVYASKKEGEKTFVLRKVNLEHKCEGDPQNRNRSADPHFVKDFVLDQMKNKPKKVVPDPYKIKEDFLAEKRVNIPYQCAWKARNLVLESLYGNYKESYNEVPAFCKMFTKCNDGSVAKFTFDTVNNTFESMTLSFEPAMRGWRKACRGVIGLDACHLTGEYGGVLMAATALDGQNGLVMLGIMVCRAETKENWIIFLKHLKDAILAHPVKVAFISDRQKGLLEAVGIVFPGHHHRYCWRHLYKNFKKDYKGLELYSSLWNAAKAYKEKHFQEHFDNIVKQSAAAGAYLSREDPATWSRAFFNPIHCCEHMNNNFSESFNNMINKMRNKPIIMIGIMYANLVMGTWYNRRTESASWVDGNLVPTAVTLIKKMLEFVTDYGVDPCVAGELYMVTSPKNSVFTVNILAKTCSCLQWQLRGFPCMHAVSALHSIRPQWRKYCSDYYSVENYKATYAPTFAPLDDKSEWVQWDLIQLQRGKGLNVMHKASPSAT

SEQ ID NO: 690 - protein, 165 aa, Papaver somniferum
MLKEFGLVGLHDLFEIREKWTPAYNRGTFFAGMNSTQRSDSIISFFDHSVNSRMCLREFVESCDQALERIYIRERDEDYESIHVKRIFVSQDLLVKHASEIYTRNLFIKVHEQFNASSRYRSEAIEADGDEETYRVYSFNDEVPTEQFLVKINKVTNKGVCGCQE

SEQ ID NO: 691 - protein, 104 aa, Papaver somniferum
MYANRSSVLDNDGLVMKDHKLGTEATRISHYCQRSTKLAYILGKSEKAYDVAMGFLDQAFEKLKEIDIDELRAEYGKNTQLEKYANDEQLVTENSCDAAELTHR

SEQ ID NO: 692 - protein, 140 aa, Papaver somniferum
MVGFSGSAGWTAETHRILSWQFSSTLEINEGKTNKENLSDIYRGNGSKDDERRSGSKIGLVVGLVVGLGVFGCGFCLALVFWWAQRTLMTIKRIPIWTMNLRKVRDQRSSHIATWFMQRITLMKVEKLGREDPGEFTRDF

SEQ ID NO: 693 - protein, 153 aa, Papaver somniferum
LTDFDTHFSFIIGSIEAKGNGDGITFFLAPFGSKVPPRSSVGSLALFVSERADDPRKNRVVAVEFDTFQNAWDPSPDHVGINVNSIVSVANVSWNSSMKDGRTANAQVSYNSTTKNLSVFLAYDDYPVFGGKSILYHIVDLSKVLPQRIMVGF

SEQ ID NO: 694 - protein, 539 aa, Papaver somniferum
MEEEKISLLMKNWAIDIDVLNRDSQKARWNKPSIYKLPAPTTGGSSFHHNDNNKKSAAYLPYTVSFGPYHHHKGDHLKKMDPHKHRVLGHFLRRYNINPQKLVDSLTTTSCGRQQVDHVDEANTDPKALPILAEEEVLPVLQHLMDSYDSLDDEWLYDRDGFLKLMILDGCFMLEILQWSSVYDNHNALSSGSVTAATSLAGSIDDYFYADNDPIFSRHGKLYVMSHIRRDMLMLENQLPMLLLKTLLGAVLPTQQKEDIEEHLNTIASNFCRGNSSYRNQNTGSCLHVLDLYRKSLLSILPEDLREGSALKNKNSGDHYCWGRSKAKGPTILFSGQTASADQKNSTAGSDGTGEDIIRSAMNLHDSGIKFEKSTDNLTDIWFEGHVLKLPVMVIDDITESTLLNLMAFERFHVGAGNGITSYVCFMDNIIDSSDDVKILRSAGVLHNAIGSDKAVAKLFNEMTKDVTPDPESRLEKVVQKQLDEYCRSQWHEWRANLCHTYFKSPWALLSLLAAVFLLALTICQTFYTIYPYYKPSGK

SEQ ID NO: 695 - protein, 266 aa, Papaver somniferum
MTGKRHYFSELNEKIKGQVKFGDGSSVEIEGKGSILFQSKTGEQKLVTNIYFIPNLQSNILSLGQATEVGCDVRMRQDYLTVHDPSGRLLVRVSRSQNRVYKISLMIGRPLCLNMRLEDQTWKWHARLGHISFRTLKTMSQNKMVRGLPQINDESKICESCLVGKQTRQGFPKATTFRVVVSHDVVFDETTHWNWKETNDGPSRDPGMFHMRWGQVIDEGEGPIIINTNGNNDVNQEEEENNETTENNEEEEEEEEEEEEEEEEEE

SEQ ID NO: 696 - protein, 145 aa, Papaver somniferum
MSEFERVKMKDTDTIDSFAGKLSEIASKAASLGQSIDEDKLVKKFLNSLPRSKYIHIIASLEQVLDLKKTSYEDIIGRLKAYEERILDEENNGETQGKLLYTNSYQQNSATRGRGRGRGGRVNKGRGRGGRFNSQDRTTSQNDQN

SEQ ID NO: 697 - protein, 271 aa, Papaver somniferum
MSSKFEMSDLGKLTYYLGIEVHQGVDGIHIKQEAYARRILKEAGLETCNPTKIPMEFGLKVSKAQEEAEIDPTSYGRNVGCLRYLLHTRPDLAFSVGVASRYMQSPRKSHGDVIKQILRYLRGTISYGLKYGKGGSKGIVGYSDSSHNVDQDDGKSTTGHIFYLGEAPITWCSQKQDAVALSSCEAEFMAATEATKQSIWLQELMGEIKGREPEKVLIKIDNKSAIALTKNPVFHGKTKHIHKRYHFIRECIEKEIINVEHIPGTEQKADI

SEQ ID NO: 698 - protein, 294 aa, Papaver somniferum
MLLSVNDEPRNFQEAKVSTKWTQACREEIISINRNKTWFLVDKPGGVKVIGLKWIFKVKRNADGTINKYKARLVAKGYVQESGIDFDEVFAPVARLETIRLLIAEAASNSWEIHHLDVKTAFLHGELSEDVYVEQPEGFEVKGQEHRVYKLTKALYGLRQAPRAWNTKLDQIIKGMRFIKCSKESSVYRREEKGTLLVIAVYVDDLFLTGNSLKVINEFKREMSSKFEMSDLGKLTYYLGIEIHQGVDGIQIKQEAYARRILKEAGLETCNPTKIPMEFGLKVSKAQEEAEIDP

SEQ ID NO: 699 - protein, 449 aa, Papaver somniferum
MGFEVIDRIGVVNESRTEEIGSTIVKQEVSVEEQLTSMSIHGSRNTSPSSRAGSRNTSPSSRAGSRNTSPSRQKAVKTKPRGFDEETVATFGKFIHPDIQMEDNIWAMLPEDLLNEILARVPPFMIFRLRSVCKRWNSILQDNSFLKLYSQLPSHGPCLLTFSKSPQTLQCSIFSLPLKTWYKIPFTFLPQWAFWLVGSSGGLVCFSGSDGVTFKTLVCNPLTQAWRTLPIMHYNQQRQLILVADRTDRSFKVIATSDIYGDKTLPTEVYDSKLNSWSVHQIMPAVNLCSSKMAFCDSRLYLETLSPLGLMMYRLDTGYWEQLAAKFPRSLLDGYLVAGTQKRLFLVGRIGLYSTLQSMRIWELDHSKILWVEISRMPPKYFRALLRLSAERFECFGQDNLICFTSWNQGKGLLYDVGKKVWSWIAGCALQSYNSQVCFYEPRFDVSIH

SEQ ID NO: 700 - protein, 370 aa, Papaver somniferum
MIPLLDFSHQLSLRSLKITILVTPKNLPILNPLLSENPSIKTLVLPFPNHPRLPQGVENVKDLSPNHFYTMLNAMSGLYNPILEWFKSHPSPPVAIISDFFLGWTHELACELGIPRIDFSPSGAMAIAVMDKLFQNVPKLNGDPYHQIESFPDIPSSPFYPWWQLPSLYRSLKHGEPESDFIRKSMLANFDSWGIVINSFNELESVYLDYLRKKPNGLGYYNRVWAVGPILPSDDDATGPAKERGGSGSVSTDDILSWLDTCPDSSVVYVCFGSQVVLSTKQMEGLARRLESSGVRFLWCVKEPTTGHVDGEYSVVPAGFEDRTAGKGMLIRGWAPQLPILKHRSVGSFMTHCGWNSVIEGLTSGVVMLT

SEQ ID NO: 701 - protein, 397 aa, Papaver somniferum
MARGPRSSSRSRRSATPSTNSASTWRPLVDTRRSPSNDGLGSHGSPYASNGHMSLPSSEGEHSPGQGSPLSGGEPWPEALQQTNTDSEADNSEESVIGDQRIPIAFNDNGQPIGPTRRTFSTKLGKITRNLASPGYITWKDVLLPVKESIWKSITNDYMVPQVLKDKVLKRAHKAWKNSKTPLRLICDKYTTVAEMKNNRPGNVRKEDWEKFVDMVNKDEDRVIREKMKRARKELKALHSIGRVGIASRREEMEKQNPIVQKTVRELYAMEENRNETPLDKDAVAKTFGVDGRGTVRGMGGGVSKTELRASAVSREQLRQEKLKTVAVETRVCGLEETVEELRQLALNANPSTSNPSNAQQMNVGGRRIQNIVLRNMRWGAVAFGRIDRIADENDAF

SEQ ID NO: 702 - protein, 125 aa, Papaver somniferum
MKARYQCSNVFFTELLKFMKTILPEGNTLPDSCRKAKDMIKPFNLPVEIIHACSNDCILYRKEYADCDECPKCHASRWQLPPEGSNPNAKKVPVKKLRYFPITERLQRWYGTPWIAEQMYWHSNV

SEQ ID NO: 703 - protein, 146 aa, Papaver somniferum
MRHPVDSSSWKSIDRKWPAFASEKRNVRLGLVTDGFNPFGMMTSHNTWPVMINAYNLPPSICTGKDFTMLVLLIPGPSAPNHNIDVYLQPLIEELIELWLSGKLTYDAHTKTCFTMKAILMWCIHDYPAYAHMSGLRTSGKFGCLA

SEQ ID NO: 704 - protein, 118 aa, Papaver somniferum
MYPFERFTPLTTDPFNLILLNLCTLYIWCYLLNKNYIGGSITAQHDVVEGARHWMEFIPEGKLKSYKCHGKVALRGEVYEGPHPPTSRGKPYQLTAVQHEQVQLWVLRHSDENIEWEE

SEQ ID NO: 705 - protein, 109 aa, Papaver somniferum
MTSENNKKLGGRKMLVTADNDRKTAIKHENAGQFIGEATTKISGAEHSSVGNTDKSQKGNNEGGELNVESNKFMSNTDRSSLPVNVSLGDSIAVSADYLDPRPHPPKNN

SEQ ID NO: 706 - protein, 144 aa, Papaver somniferum
MTAPTESVQCFRRKKTAVAVTHCKKGRGLIKINGSPIELVEPEILRFKAYEPILILGRQRFAGVDMRIRVRGGGHTSQIYAIRQSIAKALVAYYQKYVDEQQKKEIKDILVRYDRTLLVADPRRCEPKKFGGRGARSRFQKSYR

SEQ ID NO: 707 - protein, 362 aa, Papaver somniferum
MNAYDLLNFIFTIVFWRTHLRLFFSFFILFVLNWYSRFGKISSQQKVFSTKPVPFFQQLQEVLSFHVSHLCFRVIELKTLTGIFTAHIVTRLTYDAAAPMHWPVDIPPQPAYISRSVITSEPHAKERVLDDDEAASLTTSELPSPEIIDDDEAAASCPFSMRKFSNVQNSSEYDIIKEITFRDICGRLSNCHFLNNKIQWIGIFRVRRKYTFTFRFNFTRMLFNYYSANIIKLAFFRLSYCRHLNMGIRISMLQNHVVASQNYFIIANNDCTERASISIIHSFVCFFNCFCYEFMVLVLYSFLVTRKCSGNRYSSILGFDNFSFFHGGIEKLEWDSVIRQISERNSYSEFRTMLNWKNLDSR

SEQ ID NO: 708 - protein, 178 aa, Papaver somniferum
MLSELDLATKNRPCTFTPDMFRCSQQILEGVDLKHMLEFAGHKEEVLSTRRAKKIMEEVQIPELSDHIDVRNPELVMEQFKGYEEKVKNASSEIGDNLNVYLGSLPVLKAVKRVLLRLERICLLKSVNSKRMCLWNPDDDIKLLEKSHDAAQKAMKAGQSGKTSNRFKEVNSATLLIL

SEQ ID NO: 709 - protein, 109 aa, Papaver somniferum
MSVEEDHDDVMSEEDITVVESMTSQEHASKKRKFTSKVWNDFDWSRDKDGKEKATCKHCRKEYAYDSQKGGTSTMSRYLKKFPRLKMQDVGQLLLSTNNGEQATRARKI

SEQ ID NO: 710 - protein, 302 aa, Papaver somniferum
MNFGTNQGVNGGFSITRETSKCIPVANGPIHHWKHSNWSNVDNYGNFMTPSSKDLSLLPNRVTPTSSISISPNFAEPIQNMCPQSSTFCTSLHVSPSATLNPQMQFLQPGSLSSTEYMMPQTAQTMLPVQLQGENLVAYQRYEGQQIMNGGHTELLGDVIGAGTFDWATGRTFDVARTDNIISQQKGLQLQSKRVDFIMNHDNQNAQMDEIFTATEHSQIHGNHSQANRSFTFSLEDETNSSISSIDALHKPRMRWTQKLHDCFVQAINDLGGADKATPKSVQMKMGVEGLTIYHVKSHLQK

SEQ ID NO: 711 - protein, 268 aa, Papaver somniferum
MAFLDGNPPERLCKPVVDHIESLGGEVRLNSRIKKIELKKDGTVKRLMLTNGDAIEGDAYVIATPVDILKLLIPEEWKEVGYFKRLDKLVGVPVINVHIWFDKKLKNTYDHLLFSRSPLLSVYADMSVTCKEYYDPNKSMLELVFAPAEEWISRSDSEIIEATMQELAKLFPDEIAADQSKAKILKYHIVKTPRSVYKTIPDCEPARPLQRSPIEGFYLAGDYTKQKYLASMEGAVLSGKLCAQAIVKDCEMLAARVEEKTTAEATVA

SEQ ID NO: 712 - protein, 315 aa, Papaver somniferum
MSDQTVSVSSLDDNTQHHSLCDFNSISSSSSCFSSFPFQLNLELRSIIISYLILILILTPILPLNDNNEKKKKMTSTTASTVSSVINRIWNSNSSNSTSTTRGGTNHLLFGGFRGSIATSSSSMLLPRSLKSHQTPTARTTNKKKNNSPRRPNLQVVCMDYPRPELDNTVNYLEAAYFSSSFTVSPRPNKPLIVVIAGAGLAGLSTAKYLADAGHKPILLEARDVLGGKVAAWKDDDGDWYETGLHIFFGAYPNVQNLFGELGISDRLQWKEHSMIFAMPSKPGEFSRFDFPDVLPAPLNGIWAILRNNEMLTWP

SEQ ID NO: 713 - protein, 513 aa, Papaver somniferum
MAAGTTTTRHQHLVISSSFYCTFLLLLITQGSTVEGFGCNWGTRATHPLPADIVVKLLQDNGFDKVKLFEPDPHALTALATSGIQVMLGIPNEFLAALASSVRVAENWVQQNVSAYIRDGVDIRYVAVGNEPFLKTYGQAYLQTTFPALKNIQAALIKAGLGKQIKVTVPLNADVYQTDTDLPSGGDFRPDIHSLMISIVKFLSESSYPLTINIYPFLSLYADSHFPVDYAFFSGTATPVVDGPISYSNVFEANYDTLIWALEKNGFPSVPVIIGEVGWPTDGDPNANVEYARRFNQGLFNRIFQGQGTPKRKSAPETYVFGLIDEDAKSIDPGNFERHWGMFNYDGTLKYSLQLGNNRKLVPAKGVKYLEKQWCVMSPQASTSDPIFVESVTYACTHADCTSLSYGSSCGDLDAASNASYAFNRFYQTANQQRGSCNFNNLAVVTTTNPNTQDPKCKFDIMIDVSKQAKLSPPKSRSRSASSPGLVQQNSLSSWMISTVFVTLVLIVSSSLV

SEQ ID NO: 714 - protein, 604 aa, Papaver somniferum
MFPIQHRPYRTGINNLLVLLIGGIPIAMPTVLSVTLAIGSHRLSQQGAITKRMTAIEEMAGMDVLCSDKTGTLTLNRLTVDRSLIEVFNKNMDKDTVVLLAARASRLENQDAIDTAIVNMLADPKEARENITPVHFLPFNPVEKRTAITYIDAEGNWHRASKGAPEQILNLCQEKEQIAGKVHAIIDKFAERGLRSLGVACQEVPEKSEASPGGPWTFCGLLPLFDPPRHDSAETIRRALHLGVCVKMITGDQLAIAKETGRRLGMGTNMYPSSALLDRNRDDHEALPVDELVEQADGFAGVFPEHKYEIVKMLQEKKHICGMTGDGVNDAPALKKADIGIAVSDSTDAARSAADIVLTEPGLSVIIHAVLTSRSIFQRMKNYTIYAVSITIRIVLGFVLLTLIWKYDFPPFMVLVIAILNDGTIMTISKDRVKPSPKPDNWKLNEIFATGIVIGTYLALVTVLFYWIVTATTFIQTHFHLRTLSLTNGEVSSAVYLHVSVISQALIFVTRSQSWSFVERPGILLMCAFVVAQLVATVIAVYANVSFASIHGIGWGWAGAIWFYSLLLAAEPGICCLIERRLSLLRKITGRKIEKQSGFFLKDY

SEQ ID NO: 715 - protein, 606 aa, Papaver somniferum
MAITNDVGEEEIEMMMKYLIVRPEKGGIFNMSRYLLRYDAANHDFIETSNNHYSNDGYGDELVTVSRGISSVSDGGGGQDDHRLVIIVSIIVRKIIGVLGKPMEWMGYLVEFLLNLLSLNGGSIFSLLTVLLNGKVVRPQRNSETFISAIGHLDGRIDLYNKQMPSSTHDDPLLSSTDANGNGEMIVNDKKTSNIFDLGDDRCLMDLCMMASKLAYENAKVVRNIVVHHWKMHFVEFFNGWNDFQKEKSTQVFILCDKPVDANLILISFRGTEPFDADDWSTDFDYSWYDIPKLGKVHMGFLEALGLGNRDQVTTFHNHLQAVGGRDGYNSKTSFPDEDAKSDATRKKRLLPEMAELTAYYAVRTRLKELINEHKNAKFLVTGHSLGGALAILFPSVLVLHEEMEMMNRLLCVYTFGQPRIGDRQLGRYMEPHLNYPTPRYFRVVYCNDLVPRLPYDNNTFLFKHFGPCLYYNSLYIETELEEEPNPNFYGIKFLIPEYLNAAWELARSLTMGYTHGPEYKEGWFCILLRLMGLALPGISAHCPTDYVKSVRLGRMSSSSYSSPSRYPSRRSKYVSAIILNEELNLQCPYFRSGTWLSSFTGSSSR

SEQ ID NO: 716 - protein, 202 aa, Papaver somniferum
MCVSSNVWHGRLGHVNYKSMHKLASVGCILKFTLDKSHKCEICVESKHAKKSFRKNVQRNTKPLELIHSDVVDMKSVQTRGGKKWFVTFIDDCTRYCQDYLLRGKDDALEAFKIYKREVENQLNATIKTFRSDRGGEYLIPIGDFCEEHGIIHETTAPYSPQSNGVAERKNRTLKDMMNAMLISSGLPADLWGEAVLLTSIS

SEQ ID NO: 717 - protein, 312 aa, Papaver somniferum
EHLKYIRDMASKPGILTEWPWATLGRFKYILLAPFVLDSLSPLFFESDTRKWDLSYSLTFPFLLWRVIHNQIWISFSRFRTSKSKNRILDKSIEFEQVDRESNWDDNIILQGLMFYLGQKYLEGGSHLPLWRTDGVVMTILLHTGPVEFLYYWLHRSLHHHFLYSRYHSHHHSSIATEPITSVIHPFGEHLMYFALFMIPLLNMVFTGTGSIVAFAAYITYIDFMNNMGHCNFEFIPSSLFTTFPFLKCIFYTASYHSLHHTQFRTNYALFMPMYDYIYGTVDKSSDELYETSLKRAEESPDVVHLTHPTTP

SEQ ID NO: 718 - protein, 406 aa, Papaver somniferum
MPMYDYIYGTMDKSSDDLYETSLKRTEESPDVVHLTHPTTPDSIYHLRLGFASLASKPYMREANNKHYFIIKWILWPLTFLWSVLFQRMLSHTFVLERNIFDDHQVTKKLLQVQTWAIPRYSYQYKRLTRQRGTINSLIEKAILDADKAGAKVISLGLLNQGEEMNRNGEVYIQKHPNLKIKIVDGSSLAAAIVLNSITNLKTQQQVVVMMRGRLTKLACYIALALCQRGIQVVVKLQSTDDFEKLRSRFFSTSSASQASLLAANNLIPSTKYSAHGNRQVWLVDDEFSSEEHMSAPKETIFIPYSQIPPWSNFKKNPKGAANILRKDCVYYSTPAMMIPSSLENVHSCENWLPRRVMSAWHVAGVVHALEGWDSHECGDKLLDVEKVWSAAVRHGFRLPIVVHSS

SEQ ID NO: 719 - protein, 136 aa, Papaver somniferum
MTVVNVCAFCNVSEESVEHLFLHCSFVGQIWEQFLHQLGIGWVHPTTVMEFLWKWKLKFSTKPLIFLRYCLPFAIWWSVWLERNDILIAQKQGRKTLTSLIIDIKSLIFSWTVNVESFKQIKFDDFVFDWVNLFRE

SEQ ID NO: 720 - protein, 265 aa, Papaver somniferum; identical to SEQ ID NO: 68

SEQ ID NO: 721 - protein, 318 aa, Papaver somniferum
MSSVQEQELPEPDHYNDVMSGDGQDDDDDVEMLDSVNEDPTVGCAPAQVARGKKNRLRSEVWEFFKLVKYKDGTTKGVCKACNVGYKYESQRGGTSAMKRHKCIKRQSMDVGQMILASQNSQMSTRVRKVDQMKLRDLFSALLIARNVPFALVEWKEFRDICAYLNDDFKPISRNTGKADVVKKHKAQKEVIRNRLKLAPGRICLTSDMWTSVTTTGYISLTAHYLDKDWVLQKKLLNFSPLPPPHTGEHLSSKLFAMIEDWGIEEKVSNITLDNAANNGACAGIMKSRLVAKKILLNDGKYFHVRCCAHILALIVKE

SEQ ID NO: 722 - protein, 722 aa, Papaver somniferum
MLNLKMEVLLLFCVAFSCIFQSNLLLINGDTDQKDAAALGVMYTSLNSPQQLTGWIANGGDPCGIGINWKGVTCTGTSVTALKLSGLQLNGNVGYNLQDLSSLKELDLSNNNLGGSIPYSLPPNLERLNLAKNTFNGAIPYSISLMASLKYLDLSHNQLQNQLGDLFNNLPELITLDVSFNALNSNLSQSLSALPSVKNIYLQNNQFTGTLDVLANLPLENLNVENNQFIGWVPAQLKGIKSLKTGGNQWFSGPAPPAPPGPPRRAKPKPKSDDNGKDKSDSNGDGKKSGLGAGGIAGIIVALLVVGLAVAFILIKKKKSKKSSTDIEKHEEDHHFTPLASNEVKEMKSMQAPSEPAKKTFETTSAAVNLRPPPIERLKSFDEEDYSTKPVVVKKANAAPISATVYSIADLQMATASFSVDNLIGEGSIGRVYQAQFDDGKVLAVKKIDSSALPNQSSRDFLEIVSDISRLHHPNVTELVGYCSEHGQHLLIYDFYKNGSLHDFLHLSDEYSKPLSWSSRVTIALGTARALEYLHEVCSPSIVHKNFKSGNILLDSELTPHLSDCGMASFVQNADHQGLDINTGSGYSAPEVAMSGQYTLKSDVYSFGVVMLELLTGRKPFDSSRSRSEQSLVRWATPQLHDIDALDKMVDSSLKGHYPPKSLSRFADVVALCVQSEPEFRPPMSEVVQALVRLVQRANMSKRNLGEDRRSEDPDVVQDDMY

SEQ ID NO: 723 - protein, 426 aa, Papaver somniferum
MAPEPEDDIMNEKNPPPLDEDDIALLKTYGLGPYSNSIKKTEKEIKEMAKKVNDLCGIKESDTGLAAPSQWDLVSDKQMMQEEQPLQVARCTKIINANTEDAKYVINVKQIAKFVVGLGDKVSPTDIEEGMRVGVDRNKYQIQIPLPPKIDPSVTMMTVEEKPDVTYADVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLESRTQIFKIHTRTMNCERDIRFELLARLCPNSTGADIRSVCTEAGMYAIRARRKTVTEKDFLDAVNKVIKGYQKFSATPKYMVYN

SEQ ID NO: 724 - protein, 431 aa, Papaver somniferum
MAEQELEMELEDYSLKKEKKKKRKRKQPIDLKIEMVKENQEKIAPLVGYFPTGYDPHKKAQDDGNGDDVKVYRHVRRSRLELVVKPKGSKVNFVGTNYSGEAEAPISCQYALGVFDKETQTLKIVKIESNKIFRLEPKFAGKDKAPDEAKVEALTAQERAERLNDLTMALGTKKAKKQVREKANLNRKENEETQKQMGEKIKKLKVLANATAGDNSEPARNIPYHDTTAETPERAYPIEKIISKGENEILQKALHYLFYTEKVALEAFPIFVRNRIQKMKEIEDETERQTLGVILSYMTHLIKFKDKHSVDHQASAKDHRIPEMLLQSFKSKFKDADDGGKKKREMSGPKNDLLISHVLVLSLMVDDFNSNPTDIAQDLRMTTLKLRPHYLNLGVKMVGGNGKGKIAQATLPVPLNFPPMEQRRRKKGRKY

SEQ ID NO: 725 - protein, 272 aa, Papaver somniferum; identical to SEQ ID NO: 671

SEQ ID NO: 726 - protein, 457 aa, Papaver somniferum; identical to SEQ ID NO: 106

SEQ ID NO: 727 - protein, 581 aa, Papaver somniferum; identical to SEQ ID NO: 108

SEQ ID NO: 728 - protein, 316 aa, Papaver somniferum
MSMERIVGAKYKLGRKIGSGSFGEIYLATQIDTNEIFAVKIENTKTKHPQLLYEAKLYNILQGGSGIAGIKWFGVDGEENVLVIDLLGPSLEDLFVYCGRKFSLKTVLMLADQMITRIEYMHSKGFLHRDIKPDNFLMGLGRKANQVYIIDFGLAKRYRESTTNRHIPYRENKSLTGTARYASCNTHLGIEQSRRDDLESLGYVLLYFLRGSLPWQGLKAATKKQKYDKICEKKLSTPIEVLCKSHPVEFASYFHYCHSLTFDQRPDYGFLKRLFRDLFTREGHQFDYIFDWTILKYQQAQKTKVQPRGPVSIPIF

SEQ ID NO: 729 - protein, 353 aa, Papaver somniferum
MKKQTKAISMSRLIGFDQISTKSGQISFEDVKILTSNGLKIFANSIILGSSSKVLEKILDRPSKHQNSVKVIPILGVPCDAVTAFIQFLYSSRCTEEEIDGYGIHLLALSHVFSVQQLKQRCTKGLSTRLMVENVVDVLQLARLCDAPDLYLKCMRFLSKEFKAVKRTEGWKFLRANDAVLELEILQYLDEIESRDKKRSRSKEERGIYLELSEAMECLEHICTEGCTNVGPYDREPTKKTGPCEKFSTCQGLQGLIKHFAMCTKRMNGGCCRCKRMGQLLKLHASICDQDDHCCKVPLCRQFKLKNQLERKADDGRWRLLVKKVVCAKTVSSLSSPKLMILRRKEEEDRQQR

SEQ ID NO: 730 - protein, 112 aa, Papaver somniferum
MLTNWSTTETRLHKFWDLRAEQKKGRLNRLPKRDAAMLKRQLYHLQTYLGGIKYMTGLPDIVIIVDQQEEYTALRECVTLGIPTICLIDTNCDPDLADISIPANDDAIASIR

SEQ ID NO: 731 - protein, 147 aa, Papaver somniferum
MFLFIFVSNWSGALLPWKIIQLPHGELAAPTNDINTTVALALLTSVAYFYAGLTKKGLGYFGKYIQPTPILLPINILEDFTKPLSLSFRLFGNILADELVVVVLVSLVPLVVPIPVMFLGLFTSGIQALIFATLAAAYIGESMEGHH

SEQ ID NO: 732 - protein, 108 aa, Papaver somniferum
MNLMNCKSPDITYIVSKLSIYTCSPEQEHWDALNRVLWYLKYCITFCFIYERYLVVLEGLCDANWIVDSEESKSTSGYVFTLARGFVSGSFSDKHILLNSLWNLRVLR

SEQ ID NO: 733 - protein, 280 aa, Papaver somniferum
MVLAMEQWSSSLERRHDEPEFNLREWALKARNISRTNTSSRRFSAPNITSFRELETKSFRSNTTITSTASSPGHTLTDEIDPSTYSFTSALKALQAKTGYGWEWLSPEGISLSSKWNEAEKYICNPFSGEFPAECLSAKTLRRRSMSSSTSKFTMSAPLDYSFRPPLSRSKSNRTQDHKEIDSQSTIQEEKAESFKKDLESIIPTNHNSSNSNGASSPAPSSTNPPVEEKRLIMQDEVEGREEPTISTIEPKFDDDQFNSHGCVCKWVILYLTKLQYEAG

SEQ ID NO: 734 - protein, 211 aa, Papaver somniferum
MKLKQLESYLGNLDQFSNPKIELEQYPTGSHIASRMLYTAENSFGDISGKVVADFGCGCGTLSIASALLGAEYVLGIDVDTDSLEIAGENAEDLEVDINFVQCDINNLNLRGKIVDTVVMNPPFGTRKKGADMNFLAVAMKVASQAVYSLHKTTTRDHIKKTALRDLNAKSAEVICELRYDVPQLYKFHKKKEVDIAVDLWRFVPQRDQER

SEQ ID NO: 735 - protein, 103 aa, Papaver somniferum
KTQKFLRQFRGKLKDSLVIEVLQLLKHRPEVGVKFFIWAARQIGYTHTPATYAALLVTLGVEDNDSSNNKNNYVRVPEHLLLEIRDDGDKVILGKLLNFLIQK

SEQ ID NO: 736 - protein, 130 aa, Papaver somniferum
MVTYNAILQVLLKADRLDAACLLHREMSNSGIGVDGLTLGSFARSLCKFGRWQEALGIIEKEDYIYDAVIYTKMISGLCEASLFEEAMEFLHRMRSNNCVPNVITYRTLLDGCLRKRQLGRCKRILSMMI

SEQ ID NO: 737 - protein, 416 aa, Papaver somniferum
MLSAGCVPNVVTYTVLIDGHCKAGDVKKACQIYSRMGGNGDMPDVSQYFRVDGNNPTEPNVFTYGALVDGLCKAHKVSEARDLFETMSGEGCEPNNVVHDALIDGLCKAGKLDEAQEVFAKMSECGHSPSVYTYSSLIDRLFKDKRVDLAMKVLSKMLENSCSPTVVTYTEMVDGLCKVGKTEEAYKLFVLMENKGCRPNVVTYTAMIDGFGKVGDINMCLKLFRQMSAKGCAPNFITYRVLIDHCCAAGHLDEGHELLQEMKQTCWPAHVTGYRKVIEGFNREFICSLGLLDVMVADGSLPIVPAYRILVHSFCKAGRLDVALELYKELVTVSDGLGLSHNLYASLIKSLSLAFKVDEAFGLYVDMTRMGYIPDISVIFNLIKGLTKVNKWDEALQLSDSICQMDINYIPGVEET

SEQ ID NO: 738 - protein, 239 aa, Papaver somniferum
MTFPKLEIVGEHKIDTVVCGFGYHSSIQNYKIVRIYYIQNQPLGRVQVYTLGGGSSGWRDLGETVYSLRHSKFCLRGDRSPFGVLANGALHWLDTEQKIVSFDLVAENLYLLPSPPFVSDTSVTNCFQLQVLGGCLCFVHLKPDKFLDIWLLRKKGESSSSDVNVQDYDSLTWIKEFSIPIMGDAAEPFSLTEVVKCYCGTSLLSVMIKKLQPSISFWVALFWMALVIVQFLIQAAFFR

SEQ ID NO: 739 - protein, 73 aa, Papaver somniferum
MKIEIEGASIDPPVFPAVNTAIFANPVGFPQRGLRRGGAMGRLRGGTGSGGRIPQRGGGRGRDKYHTEAMQIN

SEQ ID NO: 740 - protein, 589 aa, Papaver somniferum
MSLQQAGQPRPTANGTGRRRGEQETGFRSGSNFPTEKPNHGMAIVGGILNRSREGGVQGPSRDRLIYLAACLIGHRVEVQVKNGSIFSGILHAMNAENDFGIVLKMANLTKVGLSKGHKPGSDSISKAPSKTLIVPAKELVQVIAKDVSVTGSEVKNDGQLEGRQDLMIDSYISKSQFVDVGRELAPWAPDEDDLQCPELDNIFDGPWNSRKWDQFETNEALFGVKSTFDEELYTTKLDRGPQMREREREASRIAREIEGEDTKDMHLAEERGRHFDLDVDEETRFSSVLRTVDDSGYDDDEDIVLDTHNMETFGDSSGAASKRSFSDVARGKTDNLGPSPSSSSVADEAHSRFNAGRDQYFSASGDRPRQIDCESTQSRVNENKFKELDGRKNSVKESVERKSVNEVQAPNLEGSRRSQVTTQHVHPRGRSGSSASSTAESAQSGASPTMARSGLSPSSSMGSLSSEKSALNPNAKEFKFNPNAKSFTPSVSPVRPPSPVPDGSYYYPNNVSPVQHMHGLPVGVGMGAAYGGPQPVMYTPQVAPIQPAQTFLHPNGQLYGQQMIVGHPRQVLYMPNYPPDMPYKGRDF

SEQ ID NO: 741 - protein, 67 aa, Papaver somniferum
MGVFTFVCKSSGGKWSAKQFEGDVEASADCAYDLERKLVQEALSRDSSGAVQSNFSLITPTSGVFQV

SEQ ID NO: 742 - protein, 474 aa, Papaver somniferum; identical to SEQ ID NO: 623

SEQ ID NO: 743 - protein, 174 aa, Papaver somniferum
MRYLDLSRCNFYGGHDVSINQLYNLQTLVLHRCHDVKTILLGIGSLKTLRHLDLSYSDVETLPDCVVQLANFQTLDLNMCKRLVALPVNIGSLEALRVLKVKNCITLRVLHTDVGTLTRFRCLDLSVTKIKVLPKSCINNLRNLELMVFGKCRIPKEIKNWPKLRLLKHKRERR

SEQ ID NO: 744 - protein, 118 aa, Papaver somniferum
MIATVTSDAENKQVNSASVRLWLRWLRDVAYDADDVLDEFSYEAMRRSEIHRKRDQVLEFFSSSSALSFPIKMVNKIKAINKKLDEITSTMVKFELQTSDPDDDLRSTEKQDRKHFTL

SEQ ID NO: 745 - protein, 238 aa, Papaver somniferum
METLKEWVVPIYNTFPSLEKLEIFNCPKLRSIPNSFPFLKKLYLMDNNSEAVAAILATGGLTSVTFIEIRESPQLLYIPLSLLSQNNTPNLQELVIHECSEFLGFVGDDYIFEVYNNSEKNGDDDNGYDDLEALVFFLSKMNLDSNSGNISNSLLSLQLIDCPNLWVLPDIWSFNSLRKLTIFKCDELKELITNYLEESFIFLEELKVDFIQKEFIQEDPTDSRKLVNLMEFVDQWKK

SEQ ID NO: 746 - protein, 795 aa, Papaver somniferum
MFDSSYSLSSWSVGFQLGTPCFWEEVSILVQLGVLGSILICFMKKRCAHGSRSIEEGVGKYPSSIRLGFVYKSALVCSVLIAGTHILMLWMILNGYDALCKSKNSVLCKEILLEITCLITLLLVLNLRHSRSLKLTRVLRVWWILSFILSIVHTTLYTSYIHTNHRSLTIVYYVNFVSLISSTYLVGISINGATGISFITNSTTESLLNKLENHSDGKKEKESPYQRATLLQLITFSWLSPLFKVGYKKPLEQEDVPGIHIKDSAEFLSHSFNNILKQVKETKNTRSPSIYMAIFLFIRKKAAINAFFAVINAGASYVGPYLINDFVAFLTQKKHYSLKTGYIIVLAFISAKTVEVIADRQWVFGARQLGMNLKGVLITHIYKKGLHLSSQSRQSHTSGEIINLMSVDIQRITEFIWYMNIIGMLPIQISLATCILYLNLGLSSYAGLAATLMVMLCTIPLQRIQKRLQSRIMEAKDERMKATSEILRNMKTLKLQAWDMKYILKLENLRKIEYSWLWKSLHLSALWGFIFMTSPTFISAVTFGSCILLGIPLTAGKVLSALATFRMLQDSMFTLPDSLSVIAQAKVSVDRIEAYLQEDEIQDDAVIFVPKTSEVEIEIENGIFNWDVKSHSPTLSRIQLKVKRGMKVAICGTVGSGKSSLLSCILGEIPKISGEVKISGTKAYVPQSPWIFTGSVRDNILFGNPYDKVRYERTIRACALTKDLELFQAGDLTEIGERGINMSGGQKQRIQLARAAYQDADTYILDDPFSAVDAHTGSQLFEVIFSSYMIQSKRE

SEQ ID NO: 747 - protein, 366 aa, Papaver somniferum
MEMNLRLIDNQSRPWFHNEAAIEWLSFRLNILSNLVFAFSLVILVSLPEGILNPSIAGLAVTYGLHLNILQACVIWHLCNAQNKMISVERILQYSKLTSEAPLVIEECRPPSNWPEFGEICFKNLEVRYAEHLPSILKNINCKIPGRKKVGVVGRTGSGKSTLIQALFRTVEPRDGCILIDDINICNIGLHDLRSRLSIIPQDPTMFEGTVRANLDPLAQFSDKEIWEALHKCQLGDLVRNKEGKLDSTVADNGENWSVGQRQLFCLGRALLKKSSILVLDEATASIDSATDEIIQKVISQEFENRTVVSIAHRIHTIIDSDLVLVLSEGRIAEYDMPARLLEHEDSFFSKLIKEYSMRSKGSSTA

SEQ ID NO: 748 - protein, 227 aa, Papaver somniferum; identical to SEQ ID NO: 71

SEQ ID NO: 749 - protein, 298 aa, Papaver somniferum
MASSSSASKSDQPQIAKFKIALCQISVSLDKNTNIDRARTMIKDAAKIGAKLIVLPEMWNCPYANENFPIYAEDFDNRELSPSFMMLSEVACSEGVTVVGGSITERCGDQLYNTCCVFGSTGDLIAKHRKIHLFDLTGDVCFKESETFAAGNRPTIVDTDVGRIGIGICHDLRFPELAMLYRERGADLICYPGAFNMSTGNLFWELVQRARAVDNQLFVATCSPARDSSGSYMIWGHSTLVGPFGEVIATSEHEETTIIAEIDYSVCQLRRENLPLEKQKRGDIYQFVDCTKELNSQQ

SEQ ID NO: 750 - protein, 120 aa, Papaver somniferum
MSTNVIQEHKNLMTTKYFVIPCHYNTESTISFCLKISKTEIQLKQTHARLLKTLIHSSHQLHHLLTQLLKLPSKKLSYARNLFDQIPQRGCMRWVFWQVGLRFRLCLMLVRGYRLFVKVK

SEQ ID NO: 751 - protein, 435 aa, Papaver somniferum
MVQEEHDVADGGEVQEGTSAAVGVTPIVPQEVRRSSRTPKPNPRYALNYLLLTDGVEPEDIKEALAADDSGKWQLAMEDEINSLEEDGTWVLVKLPRGKKALHNKWVYRMKSEANGDIRYKERLVVKGFQQKPSVDYNEIFSPVVKMTTIRVVLSLVASEDLYLEQLDVKTTFLHGNLDEEIYMKHPEGFIVKGKEEMVCKLKKSLYGLKQARRQWYKKFDNFMHRGGYSRCNADHCCYFKRCSSDYIILLLYVDDMLVSGTSLQEVENLKKQLSSEFAVKDLGEAKQILGMRIIRDIANGVLMLSQADYIERVLKRFNMENAKPVSSPIGSQILVSSMQCAKTNEEKEYMANVPYSSAIGSLMYAMVCMRPDIAHAVGVVSRYASNPGKQHWEAVKWILRYLRGNTNVSLCYGKGGSILRGYVDADFKGDVDKR

SEQ ID NO: 752 - protein, 265 aa, Papaver somniferum
MGSSSIDVKPAETQEVSIKDQAQLWNMIYGFADSLVVRCAVELGIPDIIKNNNGPITLAQLSSKLPIPNVNSDHLYRIVRYLINLNILQQEICRNVKVYSLKPVGTLLLRDAERSMVPILLGNTQKDFLVPWHFVKEGLVNGSTTAFEKGMGMDIWKYLEGNPDQSQLFNEGMAGETSLLTKTLIEDCRDTFQNLDSLVDIGGGNGTTIKAIYEAFPHIKCTLYDLPHVVANSHDLPNIEKVPGDMFKSVPSAQAILLKVRLLLS

SEQ ID NO: 753 - protein, 544 aa, Papaver somniferum
MELFIKLPFIQPIPFSIILVTTVSIVLLYSVFFWVTDKKKKRKKAPNAAGAWPLIGHLRLLMNDKEPLYRALGSMADKYGPAFNVRLGSQHILVLSNSDMVKECFGVQNHDKLFSNRTTSLSVKYIFNEATSIGFTPFGTYWREMRKITAQQLLSKQCLESWRHLRIKEIDASFSRLNDLCCNNGTGTTTPIRMDNWIADLTYNVFASVVFGYQSGGRAAVTGDTASISEKYKNTMIEAFVVLTTSFAVSDVFPCLEWVDRLRGIVRDLKRARDALNSIAGCLIEEHRQKRSLASLSKHDSTDKGVGDPQDFIDILLSIAEQSQLPGDDPDLVIKTMILETVSGGLDTTTSTLTWTLSLLVNHPQVLKKAIEEIDMHVGLDRDVQESDIPKLVYINAIIKETMRLYPVFPLIDRFTLEECEVGGFHVPAGGRLILNVWKIQRDPSVWENPLEFKPERFLSNDDDNKVDMDFKAQKYELFPFGIGRRICPGMLSSLQVMHLVLARLIHCFDMKAASANGKIDMAEKPGIICYQIAPLEVRITTRQ

SEQ ID NO: 754 - protein, 354 aa, Papaver somniferum
MGSSIDAETHEVDIKDQAQLWNIIYGYADSLVLRCTVEIGIADIIKNNNGSITLSELVSKLPLSNVNSDNLYRLLRYLVHLNILGQQTCAAGVDRVYSLKPVGTLLLKDSERSMAPVILGLSQKDFLFVWNFVKEGLGTGSTTAFEKAMGMDMWKYLEVNPNQSQLFDEGQAGETRLLTKTLLVDCRDTFQGMDSLVDVGGGNGTTIKAIHEAFPHIKCTLYDLPHVIANSDDHPNILKVPGDMFMSVPSAQVLLLKCVLHDWTDEHCVNILKKCKEAIPKETGKVIIVDVALEEESEHELTKARLILDIDMLVNTGGRERTAEDWENLLKRAGFRSHKIRPIRAIQSVIEAFP

SEQ ID NO: 755 - protein, 175 aa, Papaver somniferum
MCVHYELPDNHLHTPRLVEKVELPEKAITEADIVKQPLWHEYEGWEPPRDRSQIIQSECKQVTNAKRSVPELNDNEAWRGAGTGFSAGRGKTIQKTSCPDTNIQPSTAGGGLNNGKGRRSYPNRGKAFTQRVSSYDSYNTRSRFQPSPAANDSSSGPSYVARSPSYVAQRWSGEP

SEQ ID NO: 756 - protein, 76 aa, Papaver somniferum
MFLNPYEHPKCNLNRQDLFLIRMSGSNETWSVDSFGCITKPSLNTQNSNSYLFFLFLPLRLFSFSACAIKSSNEYS

SEQ ID NO: 757 - protein, 394 aa, Papaver somniferum
MAGFSSTPVHISIFLFSLCILSLSSLSWSSSGSNLERQNDDYEKWVSWNVENHKKKISTTWETNQGMVTAGHRKRSGRSVVDSKLRRADLRTVRMCVSQDGSCDFASIREAIDSIPLNNTRRTILDIKPGLYREKIVVPLAKPFITFMGDSQNPPTITGNDTASTIGDDGRPLTTFHSATVAVNSDYFVAINVIFENTVPHVTGTLAEQAVALRISGNKAAFYNCTFYGYQDTLYDHKGLHYFKNCFIQGSVDFIFGYGRSLYETCYLNSVATKVASMTAQKRTNSSLSSGFSFKDSVVTGSGLLYLGRAWGDRSRVIFSYTFMDKVVLSQGWNDWGDQKRERSVYYGEYKCSGPGANATGRVQWARLLSDHEAKPFIGAYYIDGDAWLTSQTL

SEQ ID NO: 758 - protein, 208 aa, Papaver somniferum
MAAAAVTTPVVEGTGAPQYDVKLFNKWTFDEVEVSDISLVDYVGVAARHATYVPHTAGRYSAKRFRKAQCPIVERLTNSLMMHGRNNGKKIMAVRIIKHVMDIIHLLTDQNPIQVIVDAVINSGPREDATRIGSAGVVRRQAVDISPLRRVNQAIYLLTTGARESAFRNVKTIAECLADELINAAKGSSNSYAIKKKDEIERVAKANR

SEQ ID NO: 759 - protein, 408 aa, Papaver somniferum
MEGKVGGGVGGEIRRVHIIYFLSRMGRVEHPHLIRVHHLSKNGVHLRDVKRWLSELRGKDMPDAFAWSYKRRYKTGYVWQDLLDDDLISPISDNEYVIKGSEITTLSFDPCFHGEKKGSTLAKAETITSIEEIKSKIPDSKSSNGGESQFDGEDSGPLDSETSTESSESIKERNSDDDHQKQRSIVPITEIKELNDETENSLQKNDKNEITEKQNPSSSSSTTSTARSSSSSSSSSSFNKSKSYSSGGATNVFRSLLSCRATDINDSALMMIRRSSCSSSSEICKFENLGGSDTNTSGILWNQHQSRRSISKPSSSSSSENSTSKKSNEFGGSLKKVSAAFKPVAEPHCSQCGKGFKPERLHSHMKSCRGLKSLSKNRNSATAGYDFETEQKFTTLGSFKERNQQGCF

SEQ ID NO: 760 - protein, 182 aa, Papaver somniferum; identical to SEQ ID NO: 614

SEQ ID NO: 761 - protein, 120 aa, Papaver somniferum
MNRTLLEKVRCMLSNAGLGKEFWAEAVTCACFLINRFPSAVLEGKTPMEKWFGKPAYDYDSIYIFGCPAWYHVSKNKLDSRVVKRIFVGMKSGVKGFKIWNPVEKKIVMSIDVTFMRCLW

SEQ ID NO: 762 - protein, 612 aa, Papaver somniferum
MEEEEQPIEIRALKSLGLGFDLTSDFRLKFAKKGNKGEDDGIGRLIVLDEEDQRDVVLPGGKIISGVSRDIKCDKGDRIRFKSDVVEFNQMSELLNQKSTVQGKIPSGYFNSIFDFSGLWMADATDTKYLAFDGYFISLYYLHLTTSPLVLQGRIKKAVPSNWDPASLSRFIRTFGTHIIVGLAIGGQDVVCVRQKHSSSIPPADLKQYLEDLGDSWFSDGGSTSPFRRTGDAKRKVPEVFQRVLQSNRMQLNRITETSSKDGLTVVCSKRGGDAYLHTHHKWLQTVASNPDAILFKFVPITSLLSGIPGSGYLSHAINLYLRYKPDPKDLQYFLEFQVPRQWAPMFNELPLGHQRRASCPSLQFSFMGSKLHVNSTQVSSGRTPAVGLRLYLEGKACNRLAIHVQHLSNLPRLLESSWAGPTTLKQCQWRGSDESSVPYLEPIKWKRYSNICTSVVKHDPGWLHGESPGVFIVTGAQLMTKGKWPKHILHLRLLYTHIPGFSIQKTEWAVAPASSQKSSFLTNFSTTFTTSGPSKAAPVVAINSGVYSDGPPRPVHSQKLLKYVETSEIVRGPHDIPGHWMVIAAKLVTEGGKIGLLVKFALLDYSSPTSE

SEQ ID NO: 763 - protein, 187 aa, Papaver somniferum
MVLFSRKGASGFSACNTAEEVTQGIDGSGLTAIITGSSNGIGAETARVLAMRGVQIVMAVRNTAAGTAVKETILKETPSATIEVLELDLSSMASVRKFAGEFESLGLPLNILVNNAGVMALPYKLSPDKIELQFATNHLGHFLLTNLLLETMKKTASQSNIEGRIVNISSEAHKLAYKEGIRFDKLR

SEQ ID NO: 764 - protein, 198 aa, Papaver somniferum
MISFSLVLDNSLSNKMFLRHFLCLSAMFLRHFGASFLHHCGANSPIFDEWFMDCYSRFKSINNLTLIPVRSISYRGRIQTNQMVGIISLLYIIRNWASLRVIALSLCNLSVIDILIYIRILIILQLTALLTTESDNRISIDTKNVNASTASNNHMKCVFFFFLLTWWDLIYLMVEGDKVWRTASNNHMKYVFFFFLLT

SEQ ID NO: 765 - protein, 358 aa, Papaver somniferum; identical to SEQ ID NO: 26

SEQ ID NO: 766-767 - skipped (2 entries)

SEQ ID NO: 768 - protein, 337 aa, Papaver somniferum
MESNQESFWQFSDQLRLHNSSFANLSINDSIWGSSLNSKKPEERRNFDIRVGGNRNDSTFPSSNKNIDYSNNTKQVQQQQQQKNGAGSDYLNGFNDAWKIATKFGGIGDGGSSLMQKNMNFNVNGGFNKGVYSKTDNFKQSNTKIVNDNSNHKKNEEVYEGKFGKKNNNNNSNSNNNNNNNKNSVDKRFKTLPAAESLPRNETVGGYIFVCNNDTMQENLQRQLFGLPPRYRDSVRAITPGLPLFLYNYSTHQLHGIFEASSFGGTNIDPTAWEDKKCRGESRFPAQVRVLLRKICEPLEEDSFRPVLHHYDGPKFRLELNIPEALALLDIFSENSP

SEQ ID NO: 769 - protein, 636 aa, Papaver somniferum; identical to SEQ ID NO: 34

SEQ ID NO: 770 - protein, 475 aa, Papaver somniferum
MMGMSKKKKTAKNWFTSVKNAFKSSAPISSSPSSKDYSLANKIIEEGHEIPEIVSLEHYPVCDTSSLTTTIDENNAEAVLEMRDEDRRRSNHAIAMAVVAAEAAVLAAHEATKVSRFSSYNRRRFYGYSKEERAATKIQSHYKGYLARRALKALRGLVKLQALVRGHNVRKQAEMTMRCMQAIVRVQARTKADRLRLQGATSHDNEKNKAKKSATETWNNSRGRQQQARNSFSFEKEYSRSSTQKMNKQENYLSSNSMTIKNERALAYAYPYQDSVSNRQNSVDSYSDEKTNQGGWNLLDRWIDSQPWHRDKHVAAIPESSYTSRTYNTDDDNASERTADTDLVSLSPSYQLRFNPISNLSKLGINSAGSVPIRQRKQRVMVSVETENVNTPSYMATTQSAKAKAKSAQNSLLSSSSSTRRIFLNDLSMSSSTDGIGTGEVRTMNQLGPINSPSPTSSQKMMRLLKMGKPIKGVR

SEQ ID NO: 771 - protein, 184 aa, Papaver somniferum
MKISSGTRSKLKQIESISLFLDLPEEVHDEIFLKLPAKSILVSRCVCKLFYNLLSKPNFIKNHLNLTVQTKINNPKLLFSHYSRGKHPTIYSIPIDYASISSSSSVTSSLLCECDGAVLINYPFESKEMNYLEFLGSLNGLICSRISKTDRVAYEKGYFLETDYFSILNPLTREFKEFTKPEYS

SEQ ID NO: 772 - protein, 1316 aa, Papaver somniferum
MDLATIFVSPILQDLIPKLLTYCSDEFNLVWGWGVKDDLRKLAQTLKKIEAVLHDAEKRQGGNDKLVKIWLGELQDVAYDAVDIFDELHIKDLEQKKKTVSKVFPCLPLKPFGFDYKIALKVKDVNEKLDRITKDMERFNFTSQFGSSSTSGSNITVMNEIREETSSHISDSSAVVGRIDEKLEIIKLLNQDDYSVVRITGMGGMGKTTLAQFVYANTSDDTFVVKKWVSMYGKTKPEEIFLDLLEPKPDRRSSLDEIKASLKQKLMVGKSLIVLDDVWTNHGIDIKKLLKDILSMSSLRIKILMTMRSTEPIPPLTGCRYKTYPLQGLVEDDCWSIIKKTAFAHGGAEETEDLINIGRQISIKCGGLPLAAKTLGGLLYSKKNVEDWLFILNSKIWNLPPTDDKIMSILKLSYDHLSPDVKRCFSYCSIFPKGHVFSKNEVIRMWMAEGFLISPWQANESPEIVGNGYFKILLLNSFFQDERRNIWGDIKSFRMHDLVHDLSVSITGCESLNITIDDIPKIDQSFTFRRLGLQVLHSGVSTAIPSEIYKAFKKLHTFVYSGLHDGEDVWARRVCTFGFIRVLKLSHTGIEELPKSICKLKHLRYLDVKRCNRLKELPQDIRKLIGLEYLIFRNKYTLSAKMPRKVSRLSALKKLSVFIVGEEGKGSGIEELKDLNLLGGKLSIEDLGNVTDGTQANLMGKKNIRHLELSWDSRGCNDPDRIIKDVEVINDLQPHLNLKKLGVSHFGGSEIPTWLRSASVHLPKLVSITLYRCNECEHFPALGGLQHLKYLFMDGFGGVKRIGNEFCPSNEEAVSFPSLVLLYIYHYTNSVNSDRSSRASTFSWSEDLENQNGSTLSTTPTEFPFLRKLYFHIERQVDANLKSLSPKLLWGVLQTLLVAGCNEFVGFEQQHRHQLDHLSYSHLRRLEVFKCPSLTVLPADFSGLNSLTYLAIEECSSLHSLPDGIQYLPALETLIIGGFSEDLTSFPFPAASGSDGEKYFVSLRVLKICGWPTLSAELPDQLQLLTCLQCFTIRGFPCLSSLPEWFRELSSLQNLYFLNCSRLQYLPSDEQMQRLTSLKTIYIWNCPLLLERCSGNEEGHKIARRKQVIGSSPSLLDHIPRDADMNLELLARRTSGIFSNQNKEKRWIDSCGRKCFMFFPTSFYIAWGDDTRYWTWLSVTEPSAASNNAEIEVPELIKVCWLDVHGTLDMSKLTPGVNYEVVFIVMLRERSYGWGKPVNLCLVLPDGQRLDQTLVLETMPKSTWIEIHVGDFQTPEQQPGDQEKQVKFNLSEQETLFWKSGLVIEGAIVRPKKSSS

SEQ ID NO: 773 - protein, 116 aa, Papaver somniferum
GKQQVEEEEQEEKEVEEEEEKEEEEEEKKRKRPGVSVKEYEDNGDLIICQLSSRRKVTIQEFKGKALVSIREYYEKDGKELPSTKGISLTAEQWFTFSKSVPGIEQAIKKMQTRSR

SEQ ID NO: 774 - protein, 125 aa, Papaver somniferum
ACCVLYLVGRNLYAFLQKLLEVLRCTLFIIVDLAVFCFRYDAVMESWQLTFNWGQGVAFQIRDVKTRVFTDIAWVTMKTYVDDPNSGPFNVTNVYEFHKGQWYLVHHHCSVILIGAEADQQNVFG

SEQ ID NO: 775 - protein, 129 aa, Papaver somniferum
MANRGTASNNSALISMIADEDTITGFLLAGVGNVDLRRNTNYLIVDSKTTVKAIEDAFKDFISREDIAIVLISQYVANMIRFLVDSYNKPVPAILEIPSKDHPYDAQHDSVLSRVKYLFSSESVAGDRR

SEQ ID NO: 776 - protein, 310 aa, Papaver somniferum
MEMDNIECVSSIEEGGEDIHQHHQFGSSKPLINNLISPATSVYELLECPVCTNSMYPPIHQCHNGHTLCSTCKTRVHNRCPTCRQELGDIRCLALEKVAESLQLPCRYGSLGCPDIFPYYSKLKHEAMCNFRPYNCPYAGSECAIVGDIPSLVTHLRDDHKVDMHTGCTFNHRYVKSNPREVENATWMLTVFNCFGQYFCLHFEAFQLGMAPVYMAFLRFMGDETDARNYCYSLEVGANGRKLIFEGTPRSIRDSHRKVRDSHDGLIIQRNMALFFSGGDRKELKLRVTGRIWKEQQNQEAGACIPNLCS

SEQ ID NO: 777 - protein, 320 aa, Papaver somniferum
MEMDNIECVSSSDGGGGMEEEDIRTHNHNHNNQFSSSKGLNNNGISPAATSVHELLECPVCTNSMYPPIHQCHNGHTLCSTCKTRVHNRCPTCRQELGDIRCLALEKVAESLELPCKYGSLGCPEIFPYYSKLKHEALCNFRPYNCPYAGSECAVVGDIPFLVTHLRDDHKVDMHTGCTFNHRYVKSNPREVENATWMLTVFNCFGQYFCLHFEAFQLGMAPVYMAFLRFMGDENDARNYSYSLEVGANGRKLIWEGTPRSIRDSHRKVRDSHDGLIIQRNMALFFSGGDRKELKLRVTGRIWKEQQNQEAGVCIPNLCS

SEQ ID NO: 778 - protein, 526 aa, Papaver somniferum; identical to SEQ ID NO: 32

SEQ ID NO: 779 - protein, 384 aa, Papaver somniferum
MIIETLDILGPNQNGNSGTHTQKPIKTRNWLLIIINCALVFCGVIGGPLLMRLYYLHGGSRKWLSSFLQTAGFPVLIFPLIFLYIKPKLSTQNNDQSSSFFMEPKLFLWSAIVGIVFGVSNFMYALGLSYLPVSTSTILFATQLCFTAIFAWLIVKQKFTAFIINAVIVMTLGSILLGINTNGDRPIGVSKTQYLIGFLMTLAAAALTGLGTPFVELSFIKATRNITYPTLLQFQVILCLFGTCLNVIGMLINKDFQAIPREADMFELGKSKYYMIICLTALTWQLSGIGLVGLILYTNALFNGIYVSVLVPFTEVAAVIFFHEKFTGLKGMALALCLWGFSSYFYGEYKMMNKVGDNETHEKIEEAESEPKRLEDQQAPYSTV

SEQ ID NO: 780 - protein, 105 aa, Papaver somniferum
MLEKKDGRLSRKFNLKKLRDTFCDTKKIFDKEGRVNPVRINATASGYLLYVLGKCIFPDSSGSLVDASYMQLLDPLDKMHEYSWGTAMVAFLNNELTKGSRALTA

SEQ ID NO: 781 - protein, 146 aa, Papaver somniferum
MKFNPRVSSSRRKNRKAHFTAPSSVRRVLMSSPLSSELRSKYNVRSVPVRKDDEVQVVRGTFKGREGKVIQVYRKKWVIHVERITREKVNGSTVNVGVNPSKCVITKLRLDKDRKSLLDRKAKGRAAADKDKGTKFTTDDVMKNVD

SEQ ID NO: 782 - protein, 134 aa, Papaver somniferum
MAIHLYKTSTPSTRNGAVDSQVKSNSRNNLISGQQRHCGKGRNARGIITARHRGGGHKRLYRKIDFRRNEKDISGRIVTIEYDPNRNAYICLIHYGDGEKRYILHPRGAIIGDTIVSGTEVPISMGNALPLSAV

SEQ ID NO: 783 - protein, 99 aa, Papaver somniferum
MTLLFPFDVVIYAGTRTDASSHFSAGCPYGKWTTERSSFEDCDTVTVNHGKHPASAIPSCASASKCMIPSNLILKVVNIGCFGRYYRFLSCIGKKLYDI

SEQ ID NO: 784 - protein, 127 aa, Papaver somniferum
MSPYRLVFGKACHLPVEIEHRAYWAIKNLNFSLDKEGAQRKLQFNELDEILRDAYDSAKEYKNKMKLVHDRNILRKSFSPGQKVLLYDTRLHLFSGKLRSRWTGPFVVRTVFPHGAVEIETPDGSSS

SEQ ID NO: 785 - DNA, 318 bp, Papaver somniferum
atgaggcgccaagcttcgtgttcagtgactaatacttgggatcttgacaaggaatgtgaggaggtgaatgtgattgtcaagaactccgggttgtggcctgcggtggagagttcgaatattgagcatgataaagttaccgtatctgcattctgtgagaggttctacagagagactgatacaatgttattcccattcggtgagatggcgacaactcccgatgatgctcaacaaattctaggcctcgaggttgatggaaaagcagtcactgagggattcgataataagtttcctttcaaggatatttacaaattgagctag

SEQ ID NO: 786 - protein, 108 aa, Papaver somniferum
MTTTSYSVSKQTQHEYLQFSTSYTGYLTRTMMIYDQLRPSMKLQLVKVYQVYHVTLEELSNWVTGTWTRRKISSWVFAVTGVKRKFRLTGDMSWPNYDPKRSIPGLKS

SEQ ID NO: 787 - protein, 339 aa, Papaver somniferum
MGSSQGSTTLSVKELKREVYFIDSLPVYVKELIAGGYAGAFAKTAVAPLERIKILLQTRTEGYHSIGVWRSLKKLLKQEGVRGFYKGNGASVLRIVPYAALHFMTYEQYRCWILNNYSALGTGPIVDLVAGSVAGGTAVLVTYPLDLARTKLAYQVLGRRGGSFGNGMSSSQSLPAYSGIRDVFKSVYREGGARSLYRGIGPTLIGILPYAGLKFYVYEELKRHVPEEQQKSVMMRLSCGALAGLFGQTFTYPLDVVRRQMQVQTMQPSNHLGNPRYRTTMQGLTSIIRDQGCKQLFAGLSINYVKIVPSVAIGFTAYDMMKSYLRVPPRQKAPSASAG

SEQ ID NO: 788 - protein, 339 aa, Papaver somniferum
MSRGREKHLDTVYKARTVVAEDTVVKQDHYNVSSHGRPEVVPQRDNEQLWSRRRRDHTADVEKERGHEVADKVSAVKEKEKDREVAETAKPQYKAFAPPPYVKQPNVVKNGIQNDTFGPEKTLLEPPVHRRYMNVGSERSHDERQEFRPAKVNHVNEHSHHDDSVSDRALKPKPMSVRRRQMKPPLSYENPTSIEGDDTMRRVPSARRREARNGLQHALDDDHKKEKDEEELAMDQLLMHYSKKPTKYEPIMVKAGLSSNVRPSSRDETERQRPSTRNETERRRPFRATSLPPEPATPPKEAGKAPSRATSFQPERLFVHPNLPEYDDLAARIASLRER

SEQ ID NO: 789 - protein, 169 aa, Papaver somniferum
MGRTIHIYGFPSYVTAELIKDFLEDYTGKGSVYALQVTIPKNKGPNPRAYADIQFTTTQNADYMSLLINQPQRLSYGTSYLKVFGRDRDIIPKPRVSMFHLKVPTLHFGCQVSNDCFYTLCKTKDVSVDFGFGFRKLCCLLSYKDPLKIKPVNYKLELSYESIWEIQLR

SEQ ID NO: 790 - protein, 1143 aa, Papaver somniferum
LNPKFCFLLLFFLCSLLPLLASIIPILFRRLPNPHLKVSINALHRLASNHSFCQMANKETDGAKSYARRDKLLGIERDVQTWWDESDVFLAESCKNPPKLGEKFFGNFPYPYMNGLLHLGHAFSLSKLEFSAAYHRLRGANVLLPFGFHCTGMPIKASADKLAREIERFGNPPVFPSKEDQIVNKVQEPEVDTSGKTEPDKFKSKKSKAASKSGGEKYQWEIMKEYGLADAEISKFQDPSHWLIYFPPVAKEDLKAFGLGCDWRRSFITTDMNPYYDSFVRWQIGKLKEMGKIVKDLRYAIYSPLDGEPCADHDRASGEGVLPQDYTLIKMEVVPPFPAKMGSLEGKRVFLAAATLRPETMYGQTNAWILAEGKYGAYEINDTDVFVVTERAALNLAYQNLSRIPEKPTCLVELIGQDLIGLPVQSPLSFNKIIYTLPMMNVLTDKGTGIVTSVPSDSPDDFMTMNDLETKKALREKFGVKAEWVFPFEVVPIINIPEFGEKSAEKVCMDLKIKSQNEKEKLAEAKRLTYLKGFTEGTMLVGEFAGMRVQDAKPLIRTKLLENSQAVSYSEPEKKVMSRSGDECVVALTDQWYITYGEEGWRKMAEECLSEMKLYHDETRNGFEHTLSWLNKWGCSRSFGLGTRIPFDEQFLVESLSDSTLYMAYYTIAHMLQNGEMYGRDASLVKPEQMTDEVWNYVFCDGLYPKSSTISQSVLNKMKQEFSYWYPFDLRVSGKDLIQNHLTFTIYNHTALLPQHHWPRGFRCNGHIMLNSEKMSKSTGNFKTLRQAIEDFSADATRFALADAGDGMDDANFVFDTSTSAIMRLTKEISWMEEILESESSLRSGPSTYADRVFLNEINIAVAETEKNFDEYMFRDALKTGFYDLQAARDEYRFSCGIGGMNRDLLWRFMDVQTRLITPICPHYAEYVWRKLLKKDGFVIKAGWPTAGIPDLTLRRANMYLQDTIASMRKLLEKQISGSKKPNKKATPVTLPSTENKPTKGLIYVNEHYDGWKAECLNILRANFNTESCQFKPDSEIQLALKQSNVGQQANFKQVQKLCMPFLKFKKDEALSVGIQALDLKLPFGEMEVLQENQELIRRHLGLEQVQVLDALNADDIIKAGQHAILLQQTPLSPGSPTSIFLS

SEQ ID NO: 791 - protein, 1015 aa, Papaver somniferum
ARILFPFHRSDSRVLFSSLMEEVAMNPNDLNPNTTTPMEEISTISMDSSTTSSSVTTTTTTITQISVSEKLQITDEQVRVSGFGSGSLLKPLVKCSEKVSESKFQVESVVGSVSVHKEVGENGGGVLEEVEIRVSEMEKVEEISDVVVLSEEEEEKEDVVGSVSVNKENGVVVLEEGENRKEIRVSEMETEEGAGAIEEEEKQDLVVDDEKMVCENVNGGDESMSAASEEEEDASGGDDKTSTGDNKMGSPVDDGDESMSAASEEDVSGGDVETTTGDKAEEAEEEEEEENMVGVDVKEDSSLAAEGISGAVKTTGKGGGGTKAEEKGKNQAHAYDMGVSNVVCTSVNDSNFGSLVVDLGICKNMGEIVKHNEEGNEYSVSDLIWGKVSSHPWWPGQIFDPQAASKLAKKHQKHDRKRLLVAYFGDQTFAWNVASSLKPFEANFSQMERQTDMEEFRSAIGSALDEISRRVQRGLLCSCVPDEACSEIKSQIITNAGIRAESSRRDGVDRNVGAATFEPGKVVENIKNFALNPLGGCDKMENVVTRAQLAAFYRSKGHPRMAEYGIWGGLLDPDFQMPALTSKTEEAPSEKRKLGSQDKPPSTPTPGGKKQKSVGSFSDDLAGKTGKEGLSQSSNEDAEFRTPGSFKVGESLRRVASQLKGSPPILNSSGGRSRKSACKIDRSSEKLNEKSKKRKITIPKEYSDPDEMLSQLHLAARDPMKGYSFLTIIVGFFTDYRNSINLDQSGSGKKKSSQLKSSGGRDGKLSKFEANAAEIYSDEEDDPYWTDMISGGTPEEQSPRKVQKRKRKPTPKAKSKKDSSTVELEKNPPSSPSLVIEEYSSSDESEGSIYTIDSKQPDPDVSTNLITEAPAVSNIIKNNADDPSPTALVLNFTQAESIPLETDLNKIFSRFGPLLESDTEVTRKCCRAKVVFKNRNDAEVAFSSAGKFSIFGPALASYQLRYLSSTPSTASPCPLPAASPCPLPAASPCPPPATSPAPLSATSPAPLSATSPAPL

SEQ ID NO: 792 - protein, 296 aa, Papaver somniferum
MDYDASPAIELHHDVQIEEVEEYFANYMINDSLGVIANTHTAFADKEQLKAESKECIELAKLFSIAVDFPKTGVPAEIPPHLRVKEYPDFMEKLDRPTYESKRVMGKLFRQVKDIAPHTSHIKSFTLEVARKSYDADMEVDGFEDYLDDAWFHKGEFDYKLANLMDYYGIKTEAEILGGSVMKLSKSFNMRRDAESISLAVRALKKEARTWFDKKSIFNSGSQEDDDIYAKASAWYHVTYHPSYFGNYRQEKSREHFLSFPWCVYDKLIHIKKNNSMRRKHNWSLEDQFMSSLRLS

SEQ ID NO: 793 - protein, 121 aa, Papaver somniferum
MAESKPEQSACQSVEEVKAPNLMERAKEEVTAIAHTDRSPKHHIETHGTSDDIDENTKPEEIKGPSVFQRAKEEIEALVEAIHPKKESSSSDDHSKKDGGGFFASIGRSLEKVCSPKGKKT

SEQ ID NO: 794 - protein, 103 aa, Papaver somniferum
MAEIDLELPVIEAKSVEDLNAVLKQLHEGDNSEASVVNKPVLKESTASDHMLDEPLLIETKDELGELTPYTQERHLAETDLELPVIEARFIEDVDAVLKQLHK

SEQ ID NO: 795 - protein, 368 aa, Papaver somniferum
MKEADLLNKQMDALIAFRIKVENPDGTNHHFVNWSVEMNELASGVAASAAAVSLTSPRVASPATVTISALPSPTAMPHMDAISTDDSVRGGRRFTDSTSTDAVSRPASLDVLNHVTFNNTLDTPRSTIKGMLKNNEITYGRKNLHKVEQQLQQAFVELYSELRLLKSFSFLNVLAFSKIMKKYDKISSRNASKSYLHMVDNSYIGSFDGVTRLMERVEATFIKHFTNANRSKGIRILRPAAKRERHRTTFSLGFFAGCGLALLASLILIVRARNILGMDGSTIYMETLFPLYSLFGFIVLHMLMYAINVYAWRRYRVNYPFIFGFKQGTELGYREVFLISSALATLALASVLANLDMEMDKNTKDFKT

SEQ ID NO: 796 - protein, 117 aa, Papaver somniferum
MRINFLIPLDHQPEVKQTYQQFLMYGPLLLIGKHLVHLLDCKKKFYDATLKFSGSTYVTFNLFLDEVICINDVLQEWVKNDNVLFADMAGWMVLKYEKYWAVDKINKMLYIVVLLDT

SEQ ID NO: 797 - protein, 690 aa, Papaver somniferum
MATGDDNSDSVLSDVEGDDPVPIVLDTHSSSKESVVSIERFQEVVSELDRERKAREVAEKAKSELQVSFNRLKALTHEAIKKRDESVRQRDEAVREKEEALSFNEKTLKELEEVVRLKDELLKQRDESAQELDDVVKARDSTMSEIEASTQLLVTGIEKISGKVSNFKNFSVGGLPRSQKYSGLPAVAYGIIKRTNEIVEELLKQIDTATKSRNDAREQIDHRNYEIAIEVSQLEAAISGLREEVAAKASGIENLEKSLSDKEIMVSEMNEKLNVADKEVGELKQLVNDYDGKLKNLESKMESQRPLQSEQLKYISNIHEQLHEIIKIVDENKLDHPDLSHSMFLPQMDMDENLRASLAGMESISELIKITMEKVRNQVEVKGREAKNLNETVARLVKEKSHIGTLLRSALSRKMKLDPLSKTSEVLQVAENGLREAGLDVRFTCLYGNGDKMDSHGKQAAEEIEEDEVYTLAGALEKIVNASQLEIIDLHHSVEELSSQSNQLKAQVEAQDRELSQRKLLIEELKEKESMANQSVEDLMMDIAAAEEEIARWKVAAEQEAAAGRSVEQEFLAQLSVLRQELDEMKQTMLESDKKLKFKEETAAAAMAARDAAEKSLRLADLRASRLRERLEELSQQIEESDTREDSRNRTRQRYACWPWQWLGMNYVGYQQPETQQQNSNEMELAEPLI

SEQ ID NO: 798 - protein, 172 aa, Papaver somniferum
MVRSYLVLPSPLNPTPKSKIVNPLDSRPTAGAFTKVSRKPTNHSKFTGKCGVARCTDCHINPGNKSKDKAKGTQKLKSCSAAMNQRSLAWSVVDANNGNGLNYDSKSATGILCAISSSEYFDDYDDDDDDDIEFEEYESNEQLTSLTGAEQFQEIEFVLDCQAEEDVGWCVL

SEQ ID NO: 799 - protein, 733 aa, Papaver somniferum
MDLGNSEVERNQRLESLIARRRARKSFRMSESEMNMMDLDFNGPPFQIAPISTGRRNPFDLHYDSYMGPGLPPMPGSAPSVMLPRRNPFDLPYDDPLEERPDLAGDSFGEEFMTAHEKDMHYRRCESFNMGAYFFKDHRQEKNNVSRFKPRFVTEEMASEGRFSRFSRQMSEASESKMSFASETESHSTIANQEDISSLVEEKISSHQEDISNLVEEQQISSHERELSPSVEDTPGRMKLESELWKEDHLDSESDKEGKDEVDLIKVEDETDESKTTHGTQSRFYSEFLALEEHLTSYVHVNQEVGEEQHHTRSSSLSSSGVREKIKENSEDEESSHGTQSSYVHVDQDMGEHQQHTRSNSHSSSDMHEKIFDVNVDEELSALDPARGEVHEHSSSFMQSTVIDSDRVVGEDDRHTEAPVYDLSPSASKRNMSDMMSFEETVSYKDNMVFASTSSVGSDMHVEVPEPVTVEDITLLADKEASVQIGSPRKLMTPGYEKSWEPSAELCVIDENEAEKEGLPCEEASFPSSSFHPKIAAEVLQSDKDEKVDTLDLPYSDEMSSRDIALSELKDQLVQPSSSVHQENSEGISILSDISAMEDGAIQEVGGPLVDEHQEDDVSNLPTFLSTPTSPPTEFVQEVGGPLVGEHQEDDVLNLPTFLSAPTSPPSEFIGYQQHQMVFEDDSHDGTQYESKFDFNQESIGYHEANEEFDDEEPAGIEEIDEEFLTELDAVGD

SEQ ID NO: 800 - protein, 160 aa, Papaver somniferum
RHLAETDLELPVIEARFIEDVDAVLKQLHKGDNSETFIANEPELKGSAVPSAESFDHMLDDPLLLETKDMQGELTLHTQEQHLTETDLELPVIEARSIEDVDAVLKQLRGGDNSEALILNKPVSEESTVACAKSSDHGLDEPQLMETEDGQGELTHLKLE

SEQ ID NO: 801 - protein, 186 aa, Papaver somniferum
MLLRLINNVVCRVAFGLKYEEDGKNKIYLTLQETENLLAGFSTADLFPWMSWIHKFDGSDKKLDKNFGRMDEFYDKVIDEHICRCSLKTGVEEDFVDVLLRVQKDPSQGISLTRDNIKGILMDTFVAGTDTSAATLVWTMAELIRNPTTMKRAQDEVRSVIGIKEMVKESDLHKLSYTKLVIKEAF

SEQ ID NO: 802 - protein, 588 aa, Papaver somniferum; identical to SEQ ID NO: 72

SEQ ID NO: 803 - protein, 174 aa, Papaver somniferum; identical to SEQ ID NO: 743

SEQ ID NO: 804 - protein, 118 aa, Papaver somniferum; identical to SEQ ID NO: 744

SEQ ID NO: 805 - protein, 80 aa, Papaver somniferum
MELLILSTLEWKMNPATHISLLDHIIRRFGFQVFSLPSISLVAAVMLNVIDEVETENPMEYQHQLMTALKLTKEDVNECY

SEQ ID NO: 806 - protein, 227 aa, Papaver somniferum; identical to SEQ ID NO: 71

SEQ ID NO: 807 - protein, 236 aa, Papaver somniferum
MAHSLTEHVEEGSCDRTLILSNALIHMYAKCASIDQALLEFSKMHERDVITYGALITALADHGRPQEALELFSKMQKKGIQPNKVTFLGVFNACSYAGLVEQGCKYFKLMTTTCMIEPSTEHISCMVDLLGRAGKLNEAYKLILENTGASRDAGAWGALLGACAVHGNVELGEISAQRLFEIEPDNSGNYVLLANIYASVRRWDDAARVRTTLSERRMSKTVGYSWIKEENGARTF

SEQ ID NO: 808 - protein, 1121 aa, Papaver somniferum
MYTGATSHLTADSGTLNTVFNTSNIHSILIGNGHSIPVTASGTKFIDIPSRTLKLKDTLVAPDIIKNLVSVRKFTTDNHVSVEFDPSGFSVKDLNSRKILLRCNSSGELYPITTSAVSPSTSSLSHPISLAVCSHDIWHSRLGHPGKAILDNLRANSSIQCNKNQSTKLCHSCQVSKHVRLPFFESNSVTFAPFDIIHSDLWTSPLHVETGFNYYLILLDDFTNYLWIYPLKLKSQVYTKFLEFRSFVKTQFEREIKYFQCDMGREFDNSSFHDFTHKNGLVFRFSCPHTSSQNGKAERMIRRVNDITRTLMSHASVPPKYWADSLHMAVYLHTILPSKILNFSSPVSILYQRQPTYSHIRTFGCLCFPNLSATTTHKLSPRSTKCVFLGFPTHHRGYRCLDLATNKIILSRHVTFHENVFPFKNNVSTPSDCQDSPSTPSSTLLPIRFRYPTSPHPPVQPPSATTSVPSSTTQQRPDVAPPSSATAHTPSPAIHPYTPPHRRSITAPHLHIPPQQQSAPTAPDSNISVRPVTATEPDSNTSAPATAPDSNTSAPDCTIQAVTPPSSAQPGTSANSSRHVTRASRGIFRPIHRLNLNVQTQQHISNLPKSHLYALRDPNWTKAMLDGFIAMLKTNTWDLVPRPIGSHVIRSMWLFRHKFNADGTLQRYKARLVANGKSQQVGVDCFETFSLVVKPATIRTVLSIATSRSWPIHQLDVKNAFLHGDLSETVYMHQPPGFVDPARPDYVCRLRRSLYGLKQTPRAWFQRFATFITGCGFRGSVCDPSLFIYRSGRETAYLLLYVDDIILTASTDALLARFIDLMKLEFSMTDLGPLHHFLGITASRSSSGLFLSQSLYTKDIIARASMTNCNPVATPVDTHSKLSATSGPALSDPTLYRSLAGALQYLTFTRPDISYAVQQVCLFMHDPREPHMQAIKRIIRYLQGTIDHGLSLSVSNISGLTAYSDADWAGCPDSRRSTSGYCIFLGDNLVSCSSKRQATVSRSSAEAEYRGVANAVAETTWLRNLLLELHMPLQRATLVDCDNVSAVYMSGDPVQHQRTKHVEIDIHFVRERVRIGDIRVLHIPSEHQYADIFTKGLPRQLFINFRSSLSVCSSPAQTKGV

SEQ ID NO: 809 - protein, 175 aa, Papaver somniferum
MEPRKVLILVVLGLFGNISFTASQLFPPPIQSFIPIELSPPPAQNLAPPQLSPPAFQNLAPPLTPPPPPPAPFPPPPPFVPPPPPQAQSPPPPPPPPAPQHSPPPPPPHWRRPPPPWGNPNYAGRRNEWRKSGKEMNFGKKIGYLFLCVGGALQIGVISFLGFKRWKISKIKDRG

SEQ ID NO: 810 - protein, 218 aa, Papaver somniferum
MASSISKTRNLQTYFSSANRIPKLTPLFSTSNRVLSTLAESPIDSSFQAQEKKSWSRYLLFLPGAITFGLGTWQIFRRQDKVEMLDYRRNRLGLDPVVWNNISSFSSREDSGSLEFRRVMCEGIFDESKSIYVGPRSRSISEVTENGYYVITPLVPNSSDPKSVQSPVLVNRGWDPRSWREKHQKDSQNVETVLNIKIVDDGETEGSSRWKFGLRSMV

SEQ ID NO: 811 - protein, 297 aa, Papaver somniferum
MDISGEQHLDVKHDVIKNRIDANGNIIETKKDGVGVHKIEKPLQKHGGRLEHNETYCGSCYGAETTDADCCNSCEEVREAYRKKGWGMSNPDEIDQCKREGFLQKIKDEEGEGCNIYGFLEVNKVAGNFHFAPGKSFQQSNVHVHDVTAFQKDSFNISHKINKLSFGESFPGVVNPLDRVQWTQKTPTGMFQYFVKVVPTVYTDINNHTIQSNQFSVTEHFRHAIVGQPHSVPGVFFFYDLSPIKVTFTEQHVSFLHFLTNICAIVGGMFTVSGILDSFIYHGQKVIRKKMEIGKFS

SEQ ID NO: 812 - protein, 264 aa, Papaver somniferum; identical to SEQ ID NO: 69

SEQ ID NO: 813 - protein, 94 aa, Papaver somniferum
MTSESPNSSRKVVVHLRATGDAPILKQAKFKIAGTDKFAKVIAFLRRQLHRDTLFVYVNSAFSPNPDELVNDLYNNFGFDGKLVVNYACSMAWG

SEQ ID NO: 814 - protein, 108 aa, Papaver somniferum; identical to SEQ ID NO: 609

SEQ ID NO: 815 - protein, 84 aa, Papaver somniferum
MNDGALYISKLQFLVQRFNMTKLPFTKMRACCHANVTKIIQVKSFIIMLNQNIMCHAQIIDYLNLLASKYSCHIHHCGTTAMIP

SEQ ID NO: 816 - protein, 265 aa, Papaver somniferum; identical to SEQ ID NO: 68

SEQ ID NO: 817 - protein, 172 aa, Papaver somniferum
SVKAIKFQAPKIRKALIHLIKTSKNNEEKCIAQGILKNHMKNFEFFLGMVIWYDLLSVVNSVSKSLQAKDMHMGDAIEHIKMLVSFFKEYRDNGFQAALVEAKQIAVDMGISPKFQEQRVRKRKKHFDDDASEETVPDSDIDGRDLYTELKIMKRTLPAEIKKPIEKEVSPN

SEQ ID NO: 818 - protein, 221 aa, Papaver somniferum
MPPLKRKQSSGCQNRKISKKKEEFKKSLVGSLEKYVVRTSETIVVDNVNVAITDTGGNVNRTVESNTCENVDQNLNEINRDGNDAHVAGNVDTVAGGGDVNELNENNNSVNVNEEVNDMDGCTATEFNMEEPNQDIFDPKNWGKIDQKLIDFLVENGPRRVEDYDFPYDKFGKRFSRKHYTRKMANREKQDRRWLVYSVSLDKVFCFCCKLFKKDDSTQLA

SEQ ID NO: 819 - protein, 435 aa, Papaver somniferum; identical to SEQ ID NO: 751

SEQ ID NO: 820 - protein, 117 aa, Papaver somniferum
MEGETYSVYGNGVNHKVRQSFHKNFIQVQSLLDQNRLLINEINRNHESNIPHDLNRNVGLIRELNNNIRRVVLLYADLSSSLVSYEGGGGDFSGGGGRSGGLFERFLNHNGKKRKTP

SEQ ID NO: 821 - protein, 667 aa, Papaver somniferum
MMSIFSDMIDSFLEIFMDDFSVFGSSFDECLDHLVLVLSRCKQKNLILNWEKCHFMVNSGIVLGHIVSEKRIEVDKAKVDLIQQLPQPHSVKGIRSFLGHAGFYRRFIKNFSQISRPLCNLLAKDVVFNFDASCVKAWEELKTLLTTAPIVRPPDWKLPFELMCDASDYAVGAVLGQRVDRLPYVIYYASKTLNDAQLNYSTTEKELLAVVFALDKFRSYLIGSKIIIYTDHAALKYLLSKKDAKARLIRWILLLQEFDLEIRDKKGCENVVADHLSRLTLESIDEFEMIRESFPDEQLMSISDLPWFADIVNYLATGRMPSRWSRQDRSKFLAEVKHFLWDDPYLFKYCPDQIIRKCVPNTEQKNVISFCHDQACGGHFSAKKTAAKILQCGFYWPSLFKDCHDYCVACERCQKLGSISRRNMMPLNPILIVEIFDVWGIDFMGPFPISDGRLYILVAVDYVSKWVEAIATRTNDHKVVLSFLKENIFARFGTPRAIISDGGSHFRNKYFESLVRKYGITHKVATPYHPQTSGQVEVSNREIKRILEKTVNPSRKDWSLRLNDALWAYRTAYKTPIGMSPYRLVYGKPCHLPVELEHRAYWAIKELNFSLDEAGIQRKLQLNELEELRNEAYDSAKLYKQKMKMFHDKRILRKSFTPGQKVLLYDS

SEQ ID NO: 822 - protein, 262 aa, Papaver somniferum
MSEFERVKMKDTDTIDRFAGKLSEIASKAASLGQSIDEDKLVKKFLNSLPRSKYIHIIASLEQVLDLKKTSYEDIIGRLKAYEERILDEENNGETQGKLLYTNSYQQNSATRGRGRGRGGRVNRGRGRGGRFNSQDRTTSQNDQNQGKEKKDRSNIICYRCDKPGHFSSVCPERIRKMEEANKNETREADTALFMHEVVFLNEEKLIPKNYETKDSEEGVWYLDNGASNHMTGKRHYFSELNEKIKGQVKFGDGSSVEIEGK

SEQ ID NO: 823 - protein, 245 aa, Papaver somniferum
MRQDYLTVHDPSGRLLVRVSRSQNRLYKISLMIGRPFCLNMRLQDQTWKWHARLGHISSRTLKTMSQNKMVRGLPQKNGVVERRKRTLMEMTRSSLKDMQVPKYLWGEVVRHSTYLINRIPTKALKDMTPYEILRKKKPNIVHLRVFGCKAYARVDSATLKKLDDRSQTLVHLGIEPGSKSYRLFNPTTKRVIVSRDVVFDEKANWNWKETNDGPSRDPGMFHMRWGQVIETMIINTNGNNDVNQ

SEQ ID NO: 824 - protein, 186 aa, Papaver somniferum
MSIKFKFRSSVNFDSIDLEDSPSVSVRDLKSRIINQSKLKICQDFDLVLSNAITGQEFEDEEFLVESGSSVIIKRVPVDRDANSVRPAVENMAKKHYPSVHTNEPTLPAVCGKNVEVENFDDFGIDLYPAPETPLLDSDLDDDKVNCTSSVHADKEIPRCSGSGPSGVKHQNIEKSDPSEGIPKEW

SEQ ID NO: 825 - protein, 73 aa, Papaver somniferum
MNYNALFQMYVYSFSSSLYITVAILVQVTVNQQLLAILRLVDSDCSRMAGCWCFRDFCCSFMKCQTFLLGVNQ

SEQ ID NO: 826 - protein, 255 aa, Papaver somniferum
MAMMNRISSRFSRCLTSSITTLLHFDSSSSSLGRHSYNTSSLQRYAQEKPKQMIPGNNMKWGSLGPRRDYSNFASGFTPLQQKPLSSIIDIERAKNFSPEDLADIWDDYHLGRGHIGITMKAKLYHLMKQRAVTCRHFVIPLWKGTGYVTMFVQVQMPHIIFTGLEDYKARGTQAAPYFTATYFTEFAETKDMVLVRGDIVFTSKLTDTEAQWLLEATQAFYLNDARYKLVEQFNKQTHDFEFKDVLKALDMPVG

SEQ ID NO: 827 - protein, 633 aa, Papaver somniferum
MINGSPEGFFSITRGLRQGDPLSPLIFVLIEDVLSRNLSKLFAARSMHHMVSKKGVAPTFLLFADDILIFCKGNLHSLQNLKEMLGMYQRASGQYVSYAKSKFYFGGDRHSRVVAIANFMGMERALFPDKYLGIQLKPGIVRHIHVHQVMEKIMDKLAGWKGKLLSFQARLVLIKSVISSYLLHSMAVYKWPCTAIKTVERAIRNFLWSGDAEKRKHFTVLYDNLCHSRVEGGLGLKKLNDVNRAMLMKLWVSIRDSNKTWARFLKAKYFKVNGNLIDYKLGSSVFPGIRLVHNFVQRHTRSIIGNGANTSLFFDNWCADFSIASRLGITTKGPNDFKAKVSDIIVDGSWVIPPKTKDLMIRCNIDVDNLPLIGGGDDYKIWDLDSKGAFSVKSDKAAIRGPIEVSPTASLFSRSVVHPTLSVQYWKLFHKQCCASDDNVMKKTGREMPSMCRLCRDDCKDVSHITWHCKLAKRIWKWAAAIFKIQPNEDLVASYKVEKGRSRMIKDLWLVANLAIVTELWKLRNKAYFENMRVRWLKFKGRVHQVIRDNSIRMKGHMHNTLDDLRIVNFFRVKHRSCDHSDPIEFTWTPPNPGEIMICCDGASLGNPGQAGSGVVFRDSNSVVLGVLCVGLG

SEQ ID NO: 828 - protein, 414 aa, Papaver somniferum
MDELFEELVGYLMQKEEANIQENTNHEDHNSIPGGIDDDNMMPVAMMDSFNINVDYERDGDCYNPHMDLQCNVDDYDYQLGALLYDECLADLPLLDANITGNFQEGCVSGNPSDDRIQCDRLLPDVTDTSLENCDIDQYFNLMETSTMQQKTDGDVCCDPHQPQSPSPSIPDHQPQQVEDIGDDVDTSSKNLKSERNRRKRLNQQYLTLRSIVPNITKMDKRTVLVDALAYLQDILHQIQIEIENQNKVISSLNSSLGNEETINLPLRHHNEDVVSAVEKNAVDVSGNDGQVQPLFHTLLVEPVVPPGPPPFERRAIFPAIMQMEVEKLDEERYVLRIVFNKASGTMGLVQRSVEMLKGFESINVALSAYDQHHVQSSNFLRVSYSLFISSFKGKHCNYSSPFTRWATPTPFGI

SEQ ID NO: 829 - protein, 489 aa, Papaver somniferum
MGFASCLGWDNGVMLAPMGADIAGPKLVAAVANAGGLGLLASPVNMYDATLKMIKDTKKLTSKPFGAGILLGFDQSSTIKAIFDEKLACMQVYWGDFSKEMVDEAHKNGVKVIHQLGSVADAEKAIAAGVDCIMAQGPEAGGHVIGHVSVIALVPRIVDVIGDRNVTVVATGSIADARGFVAALALGAKGICMGTRFIAAEESYANDYYKQQLLHYTEADTDYTDLYSRATWRAPTRVLNTPFHQKWKPVPQDVSNNEDQPIVGYSIIHGGETILRRFAGQVANQTTAGELENMVMYGGQGVGLVTSILPAGDIVKSVVEGAEKIIKELGSRTQVKPVKAVVLLKSTEGVSGTLYFTQAGDEPTKIIGTISGLKAGLHGFHIHALGDTTNGCTSTGPHFNPAGKDHGAPGDETRHAGDLGNLTAGADGKVEVNISDKQIPLSGPNSIIGRAVVVHADPDDLGKGGHELSKTTGNAGARIACGIIGLQAN

SEQ ID NO: 830 - protein, 307 aa, Papaver somniferum
MAQLPPKVPNMTQNWPNFHHQKMPSLGNLMPTAAANGSTQQQQQQHSPSWVDEFLDFSSTKRNAHRRSASDSITFLEAPFVEECRANSAGLRPGNNEFDRLDDEQLMSMFSDDISTTIPQNLSSSNPSTPSDHNSINDDKPTPSDQQQQLKNESGEVQSSCQSDQVPPPNSNGDSIIDPKRVKRILANRQSAQRSRVRKLQYISELERSVTSLQTEVSALSPRVAFLDHQRLVLNVDNSALKQRIAALAQDKIFKDAHQEALKKEIERLRQVYHQQNLKKMNNSNNNSSTDNQNQNGTDQEDQQPIN

SEQ ID NO: 831 - protein, 666 aa, Papaver somniferum
MELPSILYLKFFETAPDGKSRNCKFCKQSYPITTALGNLGRHLKYYHPGYDKMDDAIFSLSPQPITIVSSLGDVNTRPSPQPITAGRETADNNGGAAPRSSLWPMASVTKMDDKMSNAFPSSSQLSIPTVSQGADTMGDAISRPSPQSITTASNRDVEPKNTTEIVEAASLYLKFFETAPDGKSRSCKFCNQSYPVPTAYGNLGRHLKYRHPEYEKMGEVLSSPSPQRIATVSERADKMGNAIPIPSPQPIATVTETAAKKPEAVPRPSLQPITTVAKTADKGNVTPAAKPTENSVTSFFKISLDGMSQSCKLCNLSYSIATAIGNLQRHLKHRHPDEYDKMGDIVSNSSTQLITTASTSNTVDLDNLNWLLLRWLMGGSFPPSALQDKWLSNSFKFVNPMVKLWSNERLQAIIREVFKSTREDVKASLELVNSKISLTLEFWTSYEQIFYMSVTGHWIDESWSLHKVLLDISRIPYSCSGADIYRAIVKVLKIYNIGNKILSCTHDNSQKTIHACHKLKAYLDGQNSMAFCYIPCAARTLNLIIEDGLRNAKPVISKIREFVLELNISPAISSDFKQTASAYQEGSWEFPIDISTRWSGSYAMLDIACKASKSMDAVIRKHADTLDGSYMLLMSSVSICPRLHLPSPLISWTGGNETVPSTHAYL

SEQ ID NO: 832 - protein, 225 aa, Papaver somniferum; identical to SEQ ID NO: 624

SEQ ID NO: 833 - protein, 786 aa, Papaver somniferum
MDPSIKKENGSNGGVEVVLTISSGDEPIKPQQKSPTSTSTTPTKSSETNFIPPRNSNVGGGSGGGGGGGYQEFDRPKIQMTSFCPSPEISRACGSPRRPPKVPDNITPRRALARSAFSKPKSRFVEPSAPSAADLVDKDKAPPSPFRTSPTNRVAGGTPRAGGGTKTAPVTPKTPFLSSPGGEEDEDEEIYKIDKGAPADVTSRKWETTRIIIEWILLICITGCLVCSLTVHRLQRMMMWGLELWKWCVMVMVVVCGRLVTAWIIHVLVFLIEKNFLFKKKVLYFVYGLKKSVQIVIWLSLVLLSWTLLFNRGVKRSRSTTKFLDYVSTGIISLLVGSVIWLVKTLLVKMLAGSFHVNTFFDRIQESIFHQYVLQTLSGPPMMELAEQVGAVASTGQLSFRSTKTPKGAEAPDVIDVNKLNKMKQEKVSAWTMKGLVNVIRTSGLSTISNTIDQIYSEHDEQKDKEITSEWEAKAAAYRIFRNVAKPNSKYIDEDDLMRFLSKEEVDNVLPLFEGAVETGKIKKSSLRNWVVKVYLERKSLAHSLNDTKTAVRQLNKLVSGAVIVIMIIVMLLIMGFLTTKVVVFMSSQMLLVVFMFGNTAKQIFEAIIFVFVMHPFDVGDRCVVDGVQLIVEEMNILNTIFLRYDSEKIYYPNSILANKPISNFYRSPNMGDAVEFAIDVSTTIERVGALKSRIKAYIDGKPQHWQCNHSVVVKEIENVNKMKMALYVTHTMNHQNMVEKNSRRTELMLELKKIFEDLSIKYHLLPQEVQVSYIGGAAAPTGLRP

SEQ ID NO: 834 - protein, 149 aa, Papaver somniferum
MRYEVALYYGPLMTMYDGYSMYDPHRVMRQLCYVQEEPHFDEEKPFFTVDMTECSRSQKTINVSYDPAPTQEHWDDRRRCKIDVSLLDEVTTGHEASEKYMAWYLGWARPTVSREMTAEELARKRKMASKDPATSLKFFVSILELLLLF

SEQ ID NO: 835 - protein, 108 aa, Papaver somniferum; identical to SEQ ID NO: 732

SEQ ID NO: 836 - protein, 786 aa, Papaver somniferum; identical to SEQ ID NO: 833

SEQ ID NO: 837 - protein, 357 aa, Papaver somniferum
MEVVSQIDQENQAIIWKQIYGFSESLLLKCAVQCEIAETIHNHGTPMSILELAAKLPIDQPVNIERLYRVMRYLVHQKLFNKEVITTLNGGTVQVTEKYWLAPPAKYLIRGSQQSMVPSVLGIIDEDMFAPWHILKDSLTGECNIFEKALGKSISVYMSENPEMNQISNGAMAFDSGLVISHLVNECKNIFGDEIKTLVDVGGGTGTAVAAISKAFPNIKCTLFDLPHVIADSPEIQTIKKVSGDMFKSIPSADAIFMKNILHDWNDDECIHILKRCKDVVSSGGKLIIVEMVLDVDSVHPYSKLRLTSDIDMMVNNGGKERTEEEWKKLFDAAGFASCKFTQMSAGFAAQSIIEVY

SEQ ID NO: 838 - protein, 286 aa, Papaver somniferum
MQAYSGAAIMGAAVQQPNLFTKGSSTFFPKLSATTDRFPSQVRFNPVKTCKAASSSIEGSLVTGRPPSSVSVPIPKMGGNGRGLIDRNLSEADPEVRSIIDSEKNRQFNSLELIASENFTSRAVMEAVGSCLTNKYSEGLPGKRYYGGNEYIDKLETLCQQRALAAFHLDPKKWGVNVQPLSGSPANFEVYTALLNPHDRIMGLDLPHGGHLSHGFMTPKRRVSGTSIYFESMPYRLDESTGFIDYDMLEKTATLFRPKLIIVGASAYPRDLDYPRMRKILFGLFS

SEQ ID NO: 839 - protein, 264 aa, Papaver somniferum
MGSSSIDVKPAETQEVSIKDQAQLWNMIYGFADSLVVRCAVELGIPDIIKNNNGPITLAQLSSKLPIPNVNSDHLYRIVRYLINLNILQQEICRNVKVYSLKPVGTLLLRDAERSMVPILLGNTQKDFLVPWHFVKEGLVNGSTTAFEKGMGMDIWKYLEGNPDQSQLFNEGMAGETSLLTKTLIEDCRDTFQNLDSLVDIGGGNGTTIKAIYEAFPHIKCTLYDLPHVIANSDDHPNIRKVPGDMFMSVPSAQVLLLKVKILT

SEQ ID NO: 840 - protein, 185 aa, Papaver somniferum
MKDQVNDRTDEYGGTIEKRCRFALEVVKAVVDEIGANKVGMRISPFGDFMETGDSKPEALGLFMAESLNKYEILYLHMIEMMKVDEDTSVTPYNSLPMRRAFKGTFISAGGYEKEDGNKMIDKNHADLIAYGRLFLANPDLPKRFAVDAPLNKYISDTFCIPDPIVGYTDYPFLDQSISSTNCSK

SEQ ID NO: 841 - protein, 314 aa, Papaver somniferum
KSLEVKREIKMEIVTVALIAIVFTTFLYLIVRESSPNGLPPGPKPWPIVGNLLQLGEKPHSQFAQLAETYGDLFTLKLGTQTVVVASTPLAASEVLKAHDRTLCGRYVFQSFRVKNHVENSIVWNECNETWKKLRKVCRTQLFTQKMIENQAEVREIKTMEMVKYLKKNEGIEVKIVEVIFGTLVNMFGNLIFSQDIFKLGDESSGSLEMKQHIWRMLELGNSANPGDYVPLLGSLDLFGQRKDVADCLQGVYGVWGAMLKERRIAKRQINGDTKNDFVDVLLDSGLDDQQINSLLLVSSIFSFHIQTFLIYRY

SEQ ID NO: 842 - protein, 544 aa, Papaver somniferum; identical to SEQ ID NO: 753

SEQ ID NO: 843 - protein, 81 aa, Papaver somniferum
MDILMKLLLLHEPITLYIVLVIVSIVLLYNVFFLVTPNKNKKRKAPNASGGWPLIGHFHLFISGKEIVYRTLGTMADKYGP

SEQ ID NO: 844 - protein, 116 aa, Papaver somniferum
MGSSIDAETQEVGIKDQAQIWDIIYGYADSLVLRCTVEIGIADIIKNNNGSITLSELVSKLPLSNVNSDNLYRILRYLVHLNILGQQTCAAGGDRVYSLKPVGTLLLKDSETSMVP

SEQ ID NO: 845 - protein, 67 aa, Papaver somniferum
MKILIFVTVICCFLSSLFYSDGIVGANARWRPSQVSDSETRIGEKLQYMVPTFLRAVEILAEQGRNP

SEQ ID NO: 846 - protein, 1961 aa, Papaver somniferum
MDENRVPGNNGIGNGNRSADDASYWLDACEDIPCDLINDIVDFDPVVPTQVVIDDTAHQGVDFFGGIDRILESIKNGAGFSENEIVATGVESENMVTDGRIIQSAEVNGEAQKEKLAKTELKSDGFCLIISGGEKKSSQTEVHGKEISKSSKAEVHVKEISKSSQTEVHGKEISKSSKAEVHGKETSHSKHERGDREVRRARHVEPVDRHGKRARLSDCSRHDRSNERLSKKRPRDYERTDMDRDRGRDRDRDRSSRRDHYSYSSDRKGGRDPDRRDSDRDRDRARKGYWERDQTGKVVFHSGSWEYEHEREAKRVKKQNLEKCENIEKKPEEKREKPVEELARKYQLDVLDQAKKKNTIAFLETGTGKTLIAVLLIKSLCKDMMKENKKILAIFLVPKVPLVYQQAEVIRESTGYKVGHYCGEMGQDFWDARRWQREFESNQVLVMTAQILLNILRHSIIKMETINLLILDECHHAVKKHPYSLVMSEFYHRTPKEKRPSVFGMTASPVNLKGVSSQEDCAIKIRNLESKLDAIVCTIKDRKELEKHVPMPLEVIVEYDKAASLWSLHEKIKKLEVEVEEAAHMSSRRSKWQFMGARDAGSKDELRLVYGLSERTESDGAANLIQKLRAINYALGELGQWCAYKVALAFLTALQNDERANYQLDVKFQESYLSKVLTLLQCQLSEGAVSDEEAKTSDMESDDVKCDDNLDDVEEGELPDSHAVSGGEHVDVIIGAAVADGKVTPKVQSLVKILLKYQHTEDFRAIVFVERVVSALVLPKVFAELPSLSFIKCASLIGHNNSQEMRTSQMQDTIAKFRDGRVTLLVATSVAEEGLDIRQCNVVIRFDLAKTVLAYIQSRGRARKPGSDYILMAERGNLSHQTFLRNARNSEETLRKEAIERTDLSHLKGTSKLTTVDTTPGSVYQVESTGAVVSLNSAVGLVHFYCSQLPSDRYSILRPEFIMERHQHQGGSVEYSCKLQLPCNAPFEKLEGPICSSMRLAQQAVCLAACKKLHEMGAFTDMLLPDKGSGEEGEKLDENAVGDPLPGTARHREFYPEGVAEILRGEWILSSKDTCQKMVNLHMYAVKLVDVGASKDPFLTQVSDFAVLFGSKLDAEVLSMSMDLFVAKTMITKASLVFQGSIDITVNQLVLLKSFHVRLMSIVLDVNVEPSSTPWDSTKAYLFVPVISEKCIDPSEGIDWGLVETIVGTDAWENPLQRARPDVYLGTNERTLGGDRREYGYGKLRHDMAFGQKSHPTYGIRGAIAQFDVVKASGLLPNRVATENHSEILGQGKIFMADSCINAESLVGSIVTAAHSGKRFYVDSVRYDMNAENSFPRKEGYLGPLEYSSYADYYRQKYGVDLIYKKQPLIRGRGVSYCKNLLSPRFEHSEAHEDESDENLNKTYYVFLPPELCFVHPLPGSLVRGAQRLPSIMRRVESMLLAVQLRDSINYPIAGSKILEALTAASCQETFCYERAELLGDAYLKWIVSRFLFLKYPQKHEGQLTRMRQQMVSNMVLYQCALNKGLQSFIQADRFAPSRWSAPGVLPVFDEDTKDTESSLFEPESNSSDPHKVALDNNGYEDDDMEDGEVEVESDSSCYRVLSSKTLADVVESLIGVYYVEGGKNAAHHLMSWIGIEVEFDPEEVDAVKKPCSVPDSVLKSVNFDALESSLNIKFHDKSLLLEAITHASRPSAGVSCYQRLEFVGDAVLDHLITRHLFFTYTDLPPGRLTDLRAAAVNNENFARVVVKHKLHLHLRHGSSALEAQIRDFLRDVKDELLKPGFNSFGVGDCKAPKVLGDIFESIAGAIFLDSGRDTSVVWKVFQPLMHPMVTPETLPMHPVRELQERCQQQAEGLEYKATRSGNLATVEVYIDGVQIGIAQNPQKKMAQKLAARNALVVLKEKQEIEEKEKGENGKKKNGNPAFTRQTLNDICLRRQWPMPQYRYFFLFVFELWMSYGLTSF

SEQ ID NO: 847 - protein, 107 aa, Papaver somniferum
MKNNKATNSIIFKRTPYFYFLLPRDIKSITARITGSTCSTNSEYILPKNLIINFIFSACLMSTFMPPLSAYCFRGAFFCLSDILAGALECDLNRPRPPSSVSFFFKI

SEQ ID NO: 848 - protein, 263 aa, Papaver somniferum
MPLMKFHPGSMGVDAKLITKTLDECVSQPDNENGDKDLKAKLAPQQSEQPIAAEQKKEEEDDKENHNDVKTCISVEQQVEMENLDVAEDNSDHNLRTQSTTKGEPIRKHHRAWTLSEVTQLVEGVARFGAGRWSEIKKLSFTSYSYRTSVDLKDKWRNLLRASYARPPAVRDMLNSKKQASAALPAHILLRVRELAEKHSQGPPPDLARKVGNIRGRKPGGGAGIFGRKIVGGVGKSHKVRGVGGVVSAGSKPIVNETRSGFL

SEQ ID NO: 849 - protein, 181 aa, Papaver somniferum
MVAGIIPFDDKKPIQAAFAVVNKKLRPVIPKGCPPPLRDLIEHCWTSASEKRPEFWQIVYTHLDHLVVDMCTSNGYMKVDSYIHAAFLQAWLWEHFERYAPKPLALLPESWGGSRILRWSNRRPKIGSKLIGFLDNSHTINFRPWAPMHASITQINTFAPVPSMSLSSDKEDTSVGEMVFM

SEQ ID NO: 850 - protein, 343 aa, Papaver somniferum
MSSSTSSGSFSKVHGFDIIKFNGKNNFTSWQIDVKDTLVSMKQIKAIKDKPAALPKEWSDEKWDDLVLEACSTIRLCLSREITHNFSSETSATVLWDKLKKLYLQKDLTSELYLKRRIHAFRMASGKPMVDHINDFNKICSDLSNISVTISDTDKSMILLCSLPPSYDAFVDYLLSVKIEGDNKLVFDDVVAALQAKALRKQELSDEAQAEGLFVDRGKNSNKKQKSKNRFKKNDIECYYCRKTGHIRVDCLKLKARDEKREKSDLKNVVASVSEGTEVLEDPMCGFDEEVLTVTSKSYLNDGWMLDSGVSYHMCPSKDCFNTYREVNGGTFMMGNSNACKTV

SEQ ID NO: 851 - protein, 318 aa, Papaver somniferum; identical to SEQ ID NO: 606

SEQ ID NO: 852 - protein, 458 aa, Papaver somniferum
MENTIGKSNTGDKANVRVVVVGDSGTGKSSLIVTAAAETFPQNVPPVLPPTRLPADFYPDRVPVTIIDTSSSMEHRTKLAQELKLADAVVLTYACDTPATLDRLSTFWLPELRRLEVKVPVIVVGCKLDAREDTQVSLEQVMSPIMQQFREIETCIECSARSLIQVPEVFYYAQKAVLHPTAPLFDQETQTLKPRCVRALKRIFILCDEDRDGALSDRELNDFQVKCFNAPLQPSEIVGVKRVVQEKLSEGVNDRGLTLTGFLFLHALFIEKGRLETTWTVLRKFGYDNEIKLRDDLIPLSFKRAPDQSVELTTEAVDFLKSIFNLFDLHGDAALRPAELDDLFSTAPESPWSEAPYKESAEKTALGGLSFDGFLAQWALMTLLDPVKSVANLVYIGYQGDIASVLRITRRRRLDRKKQQSDRNVFQYFMFGPKRCWEVIIYQLFTRKVWYLLKLLIK

SEQ ID NO: 853 - protein, 166 aa, Papaver somniferum
MADLQVKKIPKLPIPGRRNIMITSALPYVNNVPHLGNIIGCVLSADVFARYCRLRGYNTIYMCGTDEYGTATETKAMEEGCTPKEICDKYHAIHRDVYNWFDISFDEFRRPSSPQQIEVCQAIFKKLMENNWLSENTMQQVVHLQVSGPSKPLSELDDPAWRLAFG

SEQ ID NO: 854 - protein, 99 aa, Papaver somniferum
MQLVGLTALLLASKYEDFWHPKLRQELEELQVHSMLHTLRHDGKSKLALSRFSRCIMLVAYGAYLVFQLFSHKHLYEVGLFNAFRIIFFFILWQFWLSL

SEQ ID NO: 855 - protein, 164 aa, Papaver somniferum
MSTSNSKFIKCVTVGDGAVGKTCLLISYTSNTFPTDYVPTVFDNFSASVLVDAQIVSLGLWDTAGQEDYNRLRPLSYRGTDVFLLAFSLISRPSFENITKKWIPELRHYAPSVPIVLVGTKLDLREDKQFHIDYPGAYTISTAQGEELKKQIGALAYVEYISKN

SEQ ID NO: 856 - protein, 164 aa, Papaver somniferum
MKTSLEILSDFKQATSAYREGSWEFPIDVSTRWSGNYAMLDIARRASKSMDAVIRNHEESLASCSMLLDPAEKVAVSIMHQYLGPFHQITSSICTTKDPAVGLVLSLMDDVVKMVASCDTPDWLKIGAEDMGKKGRSYNCGLRVSTSLKISTQKAIWKRQGTIL

SEQ ID NO: 857 - protein, 94 aa, Papaver somniferum
MDIKSAFLNGISKEEVYVAQPKGFENPDFPDHMLKLKKALYGLKQAPRSWFEKLTTSIIRKGFSRGGADKTLFTKWSGKDVAISQIYVDDIIYG

SEQ ID NO: 858 - protein, 77 aa, Papaver somniferum
MSILLQNTMQRIVNLHLPHKNQPDKITRPFTKSEKYMTPSGYKCLTDISDQLQHNPPPPPTNFLWTLPCPPKVQLFL

SEQ ID NO: 859 - protein, 73 aa, Papaver somniferum
MKRNWNIHEKPDSIVSSLYNEKYLKHQPILQNIPPPPSSTIPLWRNLASLIPTLKKHLFHQIGNGSTTPIQAN

SEQ ID NO: 860 - protein, 86 aa, Papaver somniferum
MGKGKRQKIPSSRLKGFVMHTIRENSLPHPHSTQSSSSAITAGSEPRNFKEAMKHPGWRKPWKQKSELWKNKVPGNCKNYHRAREH

SEQ ID NO: 861 - protein, 114 aa, Papaver somniferum
MQDDVAKLVRGYKLCSTSKPSNMTRGLYLPLPVPSRPWESISMDFLGGLPKTKSGHDYLFVVVDRLSKMIALIPCTKTVMGADAGKLFFKHVWKHFGLPTSILSDRDSRFLSHF

SEQ ID NO: 862 - protein, 86 aa, Papaver somniferum
MLAKSEGELGFETGKGPEQIHLAFTDYEDEMRVMFITEDGKHNYVKYGTDGGDMNKAVKTLVSRYEREDMCDAPANHSIGWRDPGF

SEQ ID NO: 863 - protein, 85 aa, Papaver somniferum
MNQQIYTRWRLRRLGVTTNSIRSCNMIERMVYPVTSNNFSFTPIQSLRIPNFQPFQLLEGASLVSLASFAQFRTNHKTKLIKRNM

SEQ ID NO: 864 - protein, 108 aa, Papaver somniferum; identical to SEQ ID NO: 609

SEQ ID NO: 865 - protein, 851 aa, Papaver somniferum
MAESESTLNIKQETTPIDSIKERNEEKQNLSNGGDSKKSDVQVIDLDSSSGGSDSDDDDDNEDSDGDAHMSKDSRVGGGGSNKRKKKKRRIDNRGVVLPLGFLDPLPSKDKDGAVPKPPATPKDVVVPKPPATPKDFVASKPPNTPKEVVVPKPKDVVMVQTCKQFWKAGDYDGGGGVVEDPFAFSTGGMDHVRVHPKFLHSNATSHKWALGAFAELLDNSLDEVCNGATFVNIDMLHNIKDGSEMLLVEDDGGGMDPDKMRQCMSLGYSAKSKLANTIGQYGNGFKTSTMRLGADVIVFSRCRGKNGNSSTQSIGLLSYTFLRGTGKEDIVVPMLDYEKEGREWKELIRSSSSDWSRNVDTIVQWSPFASEADLLKQFNGIGEHGTRLIIYNLWEDDQGELELDFQSDPHDIQIRGVNRDEKKIEMAKKFPNSRHYLTYRHSLRSYASILYLRIPLRFRMVLRGKDIVHHNLINDMMLAQEITYRPQPGADGMLKDPNVVATVTMGFVKDAKDHIDVQGFSVYHKNRLIKPFWRVWNPSGSDGRGVIGVLEANFVEPAHDKQGFERTTVLARLEARLVQMQKTYWTTLCHKVGYSCRRNKKLVAAGDSSPDFLLRQSSKSTMGSTSCWEPVNGNGNMYGKGENGKPTSRFRPRSSSSEEDDSDSERPPGIRKKTKYQWQKSKDRSDINSSESDVIIQQLEAENSELKNSLSKMKESFLRDIDYERDRVKQLTTLLNGNGPTNSDPATLSRLRTENHELQDRMKKMEALFSHDVQSEKERCNLLQAKLKESEEKIVEMNKEQEAFIDIFAEERCRREKEEENLRSKLKDASNTIQELLDKVRQLEKSDGRT

SEQ ID NO: 866 - protein, 84 aa, Papaver somniferum; identical to SEQ ID NO: 815

SEQ ID NO: 867 - protein, 751 aa, Papaver somniferum
MAEEFVKSVEDGIKLSKRIYFGKDRNVTPPRAISIVSEKQQQYLPASPMMYGVISDPSIVDNPDIPSYQPHVHGRCDPPALIPLQMNSIEMEVNVWLDTVSVSMVGSWRVHCVMGSRSCDCRIAIPMGNQGSILGVEVEVNRRSFHSQLTSVEDTTDCVKLAKVEDGGFLKPNIFTLTIPQIDGGANISVKANWSQKLAFDAGQFTVNIPFSFPEYVTPAGKKIAKREKIKLNVNPGIGSEVLCKTSSHPLKEIRRQAGKLAFSYEADVLTWSNMEFNFSYAVSSKDISAGLLLQSPPVDDLDQREMFCIHLHPGNHQTRKVFRRKVVFVIDTSASMKGKPLEAVKSALSAALSKLNPEDSFSIIAFNGETYLFSSSLVPATKETIENATQWISINFIAEGGTNILLPLNQAIDMLSGAESSDSVPLIFLLTDGTVEDEKHICDVMKSHMKNKGSMSPRISTFGIGTYCNHYFLQILAQISRGYYYAAYEVDSLYVRMQKLLTEASSIIYANITIDSIDNLQELEVYPSLFPDLLSGMPLTVSGRYEGRFPDSVKIKGVLADMSNYEVDLKLQQAKDIPLDRVFAKRHIDVLTAQAWYTQSKKLEEKIARMSIQTGIPSEYTRMVVLQNDGGKKASDSIDIQEVNKLDLQKKVDSEGRKIMLLQCLGIGFGNLTATTESIPPGWGEPELPEPVADAFVKAASNCCSSLADLCCCMNCIRCCSSMNNQCGILIVQLCGGLACLGCFSCCGDD

SEQ ID NO: 868 - protein, 77 aa, Papaver somniferum
MPHQSEQDTVEDQNPSCTFPCQISLIEGWKTDGECEKITNPVKMRASIFKFEVEDWSFNAFAISETRVPIDVCKAVM

SEQ ID NO: 869 - protein, 318 aa, Papaver somniferum; identical to SEQ ID NO: 606

SEQ ID NO: 870 - protein, 81 aa, Papaver somniferum
MSMCRISENFASAVAVESKVNSFNSPLPSFRISIKPSNMFGSRIYRLNLQENIFRQSVGKKEWIKSYYKMWKAAVESFVPG

SEQ ID NO: 871 - protein, 117 aa, Papaver somniferum; identical to SEQ ID NO: 796

SEQ ID NO: 872 - protein, 356 aa, Papaver somniferum
MDTIKRKYLMLFNSVLLAIGATGGPLLLRLYFVRGGKRIWLSSALGSAGWPILILPLSLSYIFKRGGGGENGRVKFFTITPPLIIFSAFIGLLLGLNDYLYSHGVSLLPVSTSTLIMSTHLAFTAGFAFVLVKQKFTPYSINAVVLLTVGAILLGLHSNGDKPVNQSNRDYYFGFFLTVGASVISGLLFPLAELMYIKAMQALTYSLVIEMQIVTAVVASLFCIVGMIINNDFKAIPSEGKEYELGEVKYYVVLVSIAIMWQIYFVGTAGVIFCSTSLLAGIITAVILPVTEILSVVFYHESFKSEKGIALFLSFWGLISYLYGDYRENIKLKKAAQKQSSELELDENLPPQTNLQ

SEQ ID NO: 873 - protein, 73 aa, Papaver somniferum
MVSWFKSKSKFHSQSQSTNIDHVNPGFLLTRKLFIWSVIVGIITGLDSFLFAVGYSYLPVSVASLLLATQLAF

SEQ ID NO: 874 - protein, 157 aa, Papaver somniferum
MIKTFLFGTMFGFKTISSLFPNNSFINQSSNMKVSELIVNRQWMIPEMVLDFIDLADLPILHHGEDKMIWCGNSKGIFSVSNALEKIRFVMPKVSHYMKIWSSYVHPTVASNVWKIVRGAIADDMNMKKRGFNMLSRCLFCHKEEDITDHLLWHCEV

SEQ ID NO: 875 - protein, 154 aa, Papaver somniferum
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGDY

SEQ ID NO: 876 - protein, 187 aa, Papaver somniferum
MQIFVKTLTGKTITLEVESSDTIDNVKAKIQDKEGIPPDQQRLIFAGKQLEDGRTLADYNIQKESTLHLVLRLRGGMQIFVKTLTGKTITLEVENSDTIDNVKAKIQDKEGIPPDQQRLIFAGKQLEDGRTLADYNIQKESTLHLVLRLRGGMQIFVKTLTGKTITLEVESSDTIDNVKAKIQDKEG

SEQ ID NO: 877 - protein, 71 aa, Papaver somniferum
MFFSCSSIFFRVQSFYFHIRFTARLLRCAYVDRLNPPNGDGYDSDIDEIMDSSAMLGDIDGVLGDMFQEVI

SEQ ID NO: 878 - protein, 435 aa, Papaver somniferum; identical to SEQ ID NO: 751

SEQ ID NO: 879 - protein, 210 aa, Papaver somniferum
MVINHGVAESLINEMMNLCLSFFDLSPDEKSDYVGKDVLNPIRCGTSFNTSVENVYFWRDYLKVLVHPDFHAPLKPNAFRNISYEYCKRTREVAKELVNAISESLGLQGDYIEKALETKSGLQILIVNLYPPCPQPELAMGMPPHSDHGLLTLLAQNEIGGLQIKHKGKWIVANALPNSFMVNIGDHMEVRTFSHLMPHLCDFFINCIFC

SEQ ID NO: 880 - protein, 75 aa, Papaver somniferum
MGRTVKDLTESNDLKTVPSEYVFPTNPEEVEEAEQQIPIIDYHLLTSGSPDQRSQIIENLRIACLDWGFFMVIKY

SEQ ID NO: 881 - protein, 162 aa, Papaver somniferum
MGIMIKDLIESTDLISVSNSKHALPAKVEDLTTLAEESVEQVALPIIDFSLLTSGSPDQRSKIVEELRNACLHWGFFMVVNHGVPQSLKEELINSCMNFFDLSLEEKSVYEGENASDPCILDPIICGTNFNPASKSVSFWRDYLRILVHPVFHSPPKPEGLR

SEQ ID NO: 882 - protein, 67 aa, Papaver somniferum; identical to SEQ ID NO: 741

SEQ ID NO: 883 - protein, 229 aa, Papaver somniferum
MMLEAACRYQKAFERLAREDKAFKKKFCFNERSIPPVFSTSTGASNDVDMEEASTIAHNKGKKKAPPPPPIHAPYMEDWANARSFGKFLKVFFDLTVKFSYCTRVTSHEFLFNVSVIHRTMNTWVKSSDPFLSGMGTKMLDKFNKYWGEYEKMNTLMFIAVLLDPREKMKGLNFILDTLDITGPSLRKHLSTYVKTDFQELFEEYKCLYANDENMSGDVYDFLMFFHDV

SEQ ID NO: 884 - protein, 176 aa, Papaver somniferum
MSSAASAGDNVSQSSGVTDDEDSAYASLIAERAREDEEDDNVEGKTELELYLEEKREPRISPTGVQFDILGWWRTNCTRYPVLSHMARDILAIPVSYVASESAFSTGRRVIDPYRSSLLPKTVEALICTQSWLRTPVDLDLNTLITDDAEDVSECLGSLATSKFIRIDIDDEEEED

SEQ ID NO: 885 - protein, 265 aa, Papaver somniferum; identical to SEQ ID NO: 68

SEQ ID NO: 886 - protein, 200 aa, Papaver somniferum
MGWRVCIDYRKLNKVTRKDHFPLPFIGQMLERLAGHNHYCFLDDYSGYNQIVISPEDQEKTTFTCPFGTFAYRRMPFGLCNAPATFQRCMMNIFSDMIEKFLEVCMDDFSVFGSSFDECLHHLSLVLSRCKEKNLVLNWEKCHFMVRSGIVLGNIVSSKGIELDKAKVDLIKTLQVPKTVRDIRSFLGHAGFYRRFIKDF

SEQ ID NO: 887 - protein, 82 aa, Papaver somniferum
MAIEVAELLNVCWLEVNGKLDISKLNPGVKYEVVFVVMLKNSAYGWEKPVNLRLVHSGSQTQLRKEDLQKKAKVTVDRSSDW

SEQ ID NO: 888 - protein, 387 aa, Papaver somniferum
MAQYALFKFSVCFRFDFLWIFFFTFRLKKLNLLQQNNNTSATLFLPCYYFSLYIFQTKVSEEITTSSGRGGKLLNLSDSILISLIKHRQFDLVMMAKNSIPVLGLLLLCCFASITEATYKYKYQDPKKPLGARIRDLMGRMTLEEKIGQMTQIERAVATADVMKKYFIGSVLSGGGSVPAPQATAEAWVNMVNEMQKGALSTRLGIPMIYGIDAVHGHNNVYKATIFPHNVGLGVTRDPALIKKIGAATALEVRATGIPYAFAPCIAVCRDPRWGRCYESYSEDHKIVQLMTEIIPGLQGEPPKNYRKGVPFVAGKKNVAACAKHYVGDGGTTKGINENNTVINENGLYSIHMPAYYNSIYKGVSTIMVSYSSWNGQKNARQQEAYH

SEQ ID NO: 889 - protein, 428 aa, Papaver somniferum; identical to SEQ ID NO: 550

SEQ ID NO: 890 - protein, 298 aa, Papaver somniferum
MKDEYNAMLKTNTWEIVPRPRDAHVIRSMWLFRHKYNADGSLQRHKARLVANGKSQQVGVDCFETFSPVVKPATIRTVLTIATSRSWPIHQLDVKNAFLHGDLTETVYMHQPPGFVDPDYVCRLRRSLYGLKQAPRAWFQRFPKFITNCGFRGSVCDPSLFVYKSGSNTAYLLLYVDDIVLTASNNTLLHRFIDLMKREFAISDLGPLHHFLGITVTRSSSGLYFSQSLYAQEIIARASMKQCNLVSTSVDTNSKLSATSGPTIKDPTLYRILDGALQYLTFTRPDISYAVQQINNIL

SEQ ID NO: 891 - protein, 298 aa, Papaver somniferum
MDSFYKGIIFTMGKGNRTRFWEDQWLGDMPLKIAFPNLYNVSRKKNNVVSQFYFRDQEGNSNWNLDLRRRLSDVEIAEAGDLSHKLQNVTLNEDEDRRNWKWTADGAFTVRSCYLSLLPPSFFVDFPHKIVWNNNVPTKISFFTWLVHHNSLLTQDNLERKGRTLVNRCCMCKKELEIINHLFLHCSVAHSIWDVFLSGFGVGRPQGDDIKDAFKDRDRTDFTMTGNFIWNILPYVICWNIWKEHNQRMFVTEAKEKDVQKVVLDIKANILYWSHPSKALRDIIFKMLVFKWEELIRR

SEQ ID NO: 892 - protein, 150 aa, Papaver somniferum
MQQQMAVDSSLSLFSTKGTTAYIEQSTPFPTDGKQGWWSGGFGYGIWTGVLVASGFSVVPVSSLMWKNHFELAGSRLSKDDSRKAASTLFPSLSSQLTRKKDHGRAEALLIAAYGKGLVLKSEELFKPEALLPKSEECLLESDAILMKAG

SEQ ID NO: 893 - protein, 528 aa, Papaver somniferum
MVHHLDSGGLPKERVLRFAFLNSYFKTELRNPVDEAILAYVYSNGYRFEQSKWKKIDETPFDFTRRRVSVIIEADSETTDRIYPHLGTNKLVVTKGALEEVLQVCSFYDHADSGSSIPLPVEDQHKILHMGEELSNDGLRVLGVAIRRLAMVGEANSVESNMVFLGIVTFYDPPKSSAKEALRRLAEKGVEAKVLTGDSVSLAIRVCKEVGIRTTYASTGPDLELLDPSTFHETVQRATVLARLTPTQKFRVVQSLQTAGDHVVGFLGDGVNDSLAMDAADVGISVDSGVSVAKDLADIILLEKDLNVLVSGVERGRITYGNTMKYIKLSVVANVGSVVSLLIAVVLLGYEPLTARQLVVQNFLYNVGQIPIPWDTVEEDYAKFPQRWSSKSIPMFMLWNGPVCSMFDIGCLVFFWCYYEVYHPSSGDKLYHSGWFVEGLLMQTLIIHMIRTEKIPFIQEVASWPVICSTVLISAVGIALPFTPIGKVMGMTDLPLSYFGFLVVLFLGYFFLSQVVKRVYIRTYKEWL

SEQ ID NO: 894 - protein, 165 aa, Papaver somniferum
LHAVNGSQNGWDHSAGRDGSVGWPTSNEHIQQSLDAIEFIASKYGSNPTLLGIQLLNEPKAPEVPLNTLLDYYPKGYNIVRKYSATAYVIMCQLIGADPSELYHAIANMGLSNVVVDVHFYNFYQSKFDTMSPAENIQFVKESRKAQVDSLNSANRDGPLVFIEK

SEQ ID NO: 895 - protein, 608 aa, Papaver somniferum
MPEAPANDTASEYVVVDKSKIALEFIENVTTNADEVQKKVLGEILSRSSHVEYLQRYDLKGRVDRETFKKIIPVITYEDLQPDINRIANGDTSPILCGQPISEFLTSSGTSAGERKIMPTIEEELNRRSLLYSLLMPVMNEYVPGLDKGKGMYFLFIKSEAKTPSGLVARPVLTSYYKSSHFKNRPYDPYTNYTSPNETILCPDSYQSMYSQLLCGLYQNKEVLRVGAVFASGFIRAIRFLEKHWTSLCNDIRNGTIDSQITDPSVREAVLAILKPNPKLADFIQEECSKDSWKGIITRLWPNTKYIDVIVTGTMSQYIPTLNYYSNGLPLVCTMYASSECYFGLNLQPLCDPSEVSYTLIPTMAYFEFLPAHRNNGVSTKPKSLTEKERKELVDLVDVKLGQEYELIVTTYAGLYRYRVGDVLRVTGFKNKAPQFSFVCRKNVVLSIDSDKTDEVELQNAVINAVNHLVPFDSSLVEYTSYADTSTIPGHYVLYWELRHDGTTPIPPSVFEDCCLTMEESLNSVYRQGRVSDKSIGPLEIKIVESGTFDKLMDYAISRGASINQYKTPRCVKFQPIVELMNSRVVESYFSPKCPKWIVGLQQWRNQN

SEQ ID NO: 896 - protein, 476 aa, Papaver somniferum
MADEYQSSGGICSGNWWNNMKIGLSSSSSPACSTTLTDIGSYNNWPISTITDDQTVDMKYPKLNHQAASPSDTSVIAGTNDVLLDNNSNSQMMGFDLSSPLTTSDWSQPLLSSRSSEDHQQKEWSPKNCSGSSGGEDSSSIHSSFKQQQINQGFSLDPQYCYSSNKIDNSDSCTGGLPMSFSMNSASYECSPSTSTLLHSLYEPENHMEQLQRSSYDEDNRMSYPSSTTSTNYQLNPNELSPSHPNWSSKFPQFLKTAVSSRQQPSNTNINNHLQFSNNSQFWNPSPTSILTGDNPSRLLSSPQTQFLTPTLNDHQKPNSNNSLCLKPSIEEVQDSSSVAKKNKSSEPAYKRPRMETPSQLPTFKVRKEKLGDRITALQQLCSPFGKTDTASVLYEAIEYIKFLHDQVTVLSNPYMKHGSAPMQYQQNMDNSKDGERTRQDLRSRGLCLVPMSSTFSVTNETSTDFWTPTFGGTYR

SEQ ID NO: 897 - protein, 325 aa, Papaver somniferum
MLTAIPTADEIRNIVFQIKSWAASGPDGFQAGFYKHCWDVVGPDVVLMVQELFTTGILLPKLNYTYQTLIPKHDSAHTPSDFRPISLCNITYKIISKLMAVRLKTLLAKIVSPWQAAYVPGRNIMDNTIIAHEMVDYMKKTKVFPGVIAIKLDMAKAFDRMEWNFVIQVMQSLGFNDRWCSLIFQCISTSTVSLMLNGSPTTSFTPTRGPISPYLFILCMVGFSHIISHGVSSNLILPVKPAIHAPHISHLFFADDCILFTRASGSSITNLLQIINRFCATSGQLVNFNKSSIHFSSKLSDSAKADICHMLQMKPMPLHEKYLGV

SEQ ID NO: 898 - protein, 608 aa, Papaver somniferum; identical to SEQ ID NO: 895

SEQ ID NO: 899 - protein, 112 aa, Papaver somniferum
MPMFNKYLEKGLQNVRDYQVLSVSVEVVGDMCRALDDKILPFCDGIMSRLLTGLSTGVMHPSMTPLIFSCFGDFGIAIGKHFEKYLPYAMPMIQVASKICAEMEQPAEVWYL

SEQ ID NO: 900 - protein, 182 aa, Papaver somniferum
MDSINSSIYFCAYFREPIIKLLMAPLGVSGLVGKLSTELEVDCDAEKYYNMYKHGEDVKKAVPHLCVDVKIISGDPTSSGCIKEWNVNIDGKTIRSVEETTHDDETKTLRHRVFEGDVMKDFKKFDTIMVVNPKPDGNGCVVTRSIEYEKTNENSPTPFDYLQFGHQAIEDMNKYLRDSESN

SEQ ID NO: 901 - protein, 284 aa, Papaver somniferum
MIIETLDILGPNQNGNSGTHTQKPIKTRNWLLIIINCALVFCGVIGGPLLMRLYYLHGGSRKWLSSFLQTAGFPVLIFPLIFLYIKPKLSTQNNDQSSSFFMEPKLFLWSAIVGIVFGVSNFMYALGLSYLPVSTSTILFATQLCFTAIFAWLIVKQKFTAFIINAVIVMTLGSILLGINTNGDRPIGVSKTQYLIGFLMTLAAAALTGLGTPFVELSFIKATRNITYPTLLQFQVILCLFGTCLNVIGMLINKDFQVRNCYRRLTTFLIFLILEQKLISEEDL

SEQ ID NO: 902 - DNA, 825 bp, Papaver somniferum
atgatcatcgaaacactagatatcctgggaccaaatcagaatggcaattcaggaacccatactcaaaaaccaatcaaaaccagaaactggctgctgatcattattaactgcgccttagttttttgtggtgttataggtggtcctctcttaatgagactgtactatcttcatggtggtagtcgtaaatggcttagtagttttctgcaaactgctggtttcccagttctcatatttcctctcatttttctctacattaaaccgaaattgtcaacacaaaacaacgatcaaagttcttccttttttatggaaccaaagttgtttctttggagtgccatagttggaatcgtgtttggtgtttctaatttcatgtacgcattgggtttatcttatcttccagtatcaacttcgacaattctctttgcaactcaactgtgtttcacagcaatttttgcatggttaattgtgaaacaaaaatttacagcatttattataaatgcagtgattgtaatgacactaggatcgatcttattgggtattaataccaatggtgatagaccaattggggtatcaaaaactcagtacttaatagggtttcttatgacgttagctgctgctgctctaactggcctcgggacgccttttgttgagctttctttcattaaagccaccagaaatattacttatccaactttgttacagtttcaagtcattctttgtctgtttggaacctgcctcaacgtcattgggatgctaataaataaggattttcaggtacgtaactgttataggaggcttacaacctttttgattttccttattctctga

SEQ ID NO: 903 - DNA, 855 bp, Papaver somniferum
atgatcatcgaaactttggatatcttgggtccaaaccaaaacggtaactcaggtactcatacacaaaaaccaattaaaacaagaaactggttgttgatcattattaactgtgctttagttttctgtggtgttattggtggtccattgttgatgagattgtactacttgcatggtggttctagaaagtggttatcttcatttttgcaaactgcaggttttccagttttgatcttcccattgattttcttgtacattaaaccaaaattgtcaacacaaaacaacgatcaatcttcttctttctttatggaaccaaagttgtttttatggtctgctattgttggtatcgttttcggtgtttcaaacttcatgtacgcattgggtttgtcttacttgccagtttcaacttctacaatcttgttcgctactcaattgtgtttcacagctatcttcgcatggttgatcgttaagcaaaagtttactgcttttattattaatgcagttattgttatgactttgggttcaatcttgttgggtattaatacaaacggtgacagaccaatcggtgtttctaagactcaatatttgatcggtttcttgatgacattggctgcagctgcattaactggtttgggtacaccatttgttgaattgtcttttattaaggctactagaaacatcacttacccaacattgttgcaattccaagttattttgtgtttgttcggtacatgtttgaacgttatcggcatgttgattaataaggatttccaagttagaaactgttacagaagattgacaacattcttgatcttcttgatcttggaacaaaaattaatttctgaagaagatttgtaa

SEQ ID NO: 904 - protein, 10 aa, Artificial Sequence
  Synthetic construct
EQKLISEEDL

The invention claimed is:

1. A yeast cell comprising a first polynucleotide encoding a polypeptide having thebaine synthase activity comprising an amino acid sequence that is at least 90% identical to an amino acid sequence selected from the group consisting of: SEQ ID NO: 29 or SEQ ID NO: 900.

2. The yeast cell of claim 1, further comprising a second polynucleotide having purine permease activity encoding a polypeptide comprising an amino acid sequence that is at least 90% identical to an amino acid sequence selected from the group consisting of: SEQ ID NO: 779 or SEQ ID NO: 901.

3. The yeast cell of claim 2, further comprising a third polynucleotide that links the first and second polynucleotides.

4. The yeast cell of claim 2, wherein the first and second polynucleotides are integrated, respectively, into first and second expression vectors.

5. The yeast cell of claim 1, wherein the cell is a *Saccharomyces cerevisiae* cell or a *Yarrowia lipolytica* cell.

6. A method of reducing the expression of a polynucleotide encoding a polypeptide having thebaine synthase activity comprising an amino acid sequence that is at least 90% identical to an amino acid sequence selected from the group consisting of: SEQ ID NO: 29 or SEQ ID NO: 900 in a cell expressing the polynucleotide, the method comprising silencing the expression of the polynucleotide in the cell, wherein the cell is a *Papaver somniferum* cell or the cell of claim 1.

7. The yeast cell of claim 1, wherein the first polynucleotide encodes a polypeptide comprising an amino acid sequence that is at least 95% identical to SEQ ID NO: 29 or SEQ ID NO: 900.

8. The yeast cell of claim 2, wherein the second polynucleotide encodes a polypeptide comprising an amino acid sequence that is at least 95% identical to SEQ ID NO: 779 or SEQ ID NO: 901.

9. The yeast cell of claim 1, wherein the first polynucleotide encodes a polypeptide comprising an amino acid sequences that is at least 97% identical to SEQ ID NO: 29 or SEQ ID NO: 900.

10. The yeast cell of claim 2, wherein the second polynucleotide encodes a polypeptide comprising an amino acid sequence that is at least 97% identical to SEQ ID NO: 779 or SEQ ID NO: 901.

11. The yeast cell of claim 1, wherein the first polynucleotide comprises a nucleic acid sequence capable of hybridizing under at least moderately stringent hybridization conditions with the nucleic acid sequence of SEQ ID NO: 6 or SEQ ID NO: 372.

* * * * *